United States Patent
Van Der Hoeven et al.

(10) Patent No.: US 11,344,051 B2
(45) Date of Patent: May 31, 2022

(54) STEVIOL GLYCOSIDES

(71) Applicant: DSM IP ASSETS B.V., Heerlen (NL)

(72) Inventors: Robertus Antonius Mijndert Van Der Hoeven, Echt (NL); Peter Philip Lankhorst, Echt (NL); Silvia Gosiewska, Echt (NL)

(73) Assignee: DSM IP ASSETS B.V., Heerlen (NL)

( * ) Notice: Subject to any disclaimer, the term of this patent is extended or adjusted under 35 U.S.C. 154(b) by 572 days.

(21) Appl. No.: 15/563,475

(22) PCT Filed: Apr. 4, 2016

(86) PCT No.: PCT/EP2016/057360
§ 371 (c)(1),
(2) Date: Sep. 29, 2017

(87) PCT Pub. No.: WO2016/156616
PCT Pub. Date: Oct. 6, 2016

(65) Prior Publication Data
US 2018/0070622 A1  Mar. 15, 2018

Related U.S. Application Data

(60) Provisional application No. 62/142,631, filed on Apr. 3, 2015.

(51) Int. Cl.
*A23L 27/30* (2016.01)
*C12P 19/56* (2006.01)

(52) U.S. Cl.
CPC .............. *A23L 27/36* (2016.08); *C12P 19/56* (2013.01); *A23V 2002/00* (2013.01);
(Continued)

(58) Field of Classification Search
CPC ................................ A23L 27/36; C12P 19/56
See application file for complete search history.

(56) References Cited

U.S. PATENT DOCUMENTS 4,590,160 A † 5/1986 Nishihashi
6,180,157 B1 1/2001 Fotos et al.
(Continued)

FOREIGN PATENT DOCUMENTS

CA    3055288 A1   9/2018
CN  102216313 A  10/2011
(Continued)

OTHER PUBLICATIONS

Ohta, Masaya, "Characterization of Novel Steviol Glycosides from Leaves of Stevia rebaudiana Morita", Journal of Applied Glycoscience, Aug. 17, 2010, pp. 199-209, vol. 57.
(Continued)

*Primary Examiner* — Nikki H. Dees
*Assistant Examiner* — Changqing Li
(74) *Attorney, Agent, or Firm* — McBee Moore & Vanik IP, LLC; Susan McBee; Chester Moore

(57) ABSTRACT

The present invention relates to a steviol glycoside having the formula of (I)

(I)

wherein at least 3 sugar moieties are present at positions R1 and at least three sugar moieties are present at
(Continued)

position R2 and wherein the steviol glycoside comprises at least seven sugar moieties all of which are linked, directly or indirectly, to the steviol aglycon by β-linkages.

8 Claims, 13 Drawing Sheets

Specification includes a Sequence Listing.

(52) U.S. Cl.
CPC ..... *A23V 2200/15* (2013.01); *A23V 2250/258* (2013.01); *A23V 2250/262* (2013.01)

(56) References Cited

U.S. PATENT DOCUMENTS

| | | | |
|---|---|---|---|
| 6,365,216 | B1 | 4/2002 | Dron et al. |
| 9,522,929 | B2 | 12/2016 | Mao et al. |
| 9,527,880 | B2 | 12/2016 | Mao et al. |
| 9,567,619 | B2 | 2/2017 | Mao et al. |
| 9,643,990 | B2 | 5/2017 | Mao et al. |
| 9,783,566 | B2 | 10/2017 | Mao et al. |
| 9,850,270 | B2 | 12/2017 | Mao et al. |
| 10,689,681 | B2 | 6/2020 | Boer et al. |
| 2006/0083838 | A1 | 4/2006 | Jackson et al. |
| 2011/0027446 | A1* | 2/2011 | Gelov .............. A23P 10/40 426/548 |
| 2011/0033525 | A1 | 2/2011 | Liu |
| 2011/0183056 | A1 | 7/2011 | Morita et al. |
| 2013/0209658 | A1 | 8/2013 | Spelman et al. |
| 2013/0251881 | A1 | 9/2013 | Mutilangi et al. |
| 2013/0309389 | A1 | 11/2013 | Carlson et al. |
| 2014/0017378 | A1* | 1/2014 | Purkayastha ......... A23L 2/60 426/548 |
| 2014/0171519 | A1 | 6/2014 | Prakash et al. |
| 2014/0227421 | A1 | 8/2014 | Markosyan |
| 2014/0296499 | A1 | 10/2014 | Chen et al. |
| 2014/0329281 | A1 | 11/2014 | Houghton-Larsen et al. |
| 2014/0342043 | A1 | 11/2014 | Bell et al. |
| 2014/0343262 | A1 | 11/2014 | Prakash et al. |
| 2014/0357588 | A1† | 12/2014 | Markosyan |
| 2015/0031868 | A1† | 1/2015 | Lehmann |
| 2015/0257424 | A1 | 9/2015 | Catani et al. |
| 2016/0097070 | A1 | 4/2016 | Mao et al. |
| 2017/0190727 | A1* | 7/2017 | Krammer ............. C07H 15/24 |
| 2017/0240942 | A1 | 8/2017 | Robertson et al. |
| 2017/0275325 | A1† | 9/2017 | Prakash |
| 2017/0362268 | A1* | 12/2017 | Carlson ............ C07H 15/256 |
| 2017/0369922 | A1* | 12/2017 | Olsson ................ C12P 19/56 |
| 2020/0283815 | A1 | 9/2020 | Boer et al. |

FOREIGN PATENT DOCUMENTS

| | | |
|---|---|---|
| CN | 104684414 A | 6/2015 |
| CN | 105051195 A | 11/2015 |
| EP | 3383201 A1 | 10/2018 |
| JP | 2001048727 A | 2/2001 |
| JP | 2012504552 A | 2/2012 |
| WO | 0160842 A2 | 8/2001 |
| WO | 2010038911 A1 | 4/2010 |
| WO | 2010151653 A2 | 12/2010 |
| WO | 201153378 A1 | 5/2011 |
| WO | 2013022989 A2 | 2/2013 |
| WO | 2013066490 A1 | 5/2013 |
| WO | 2013096420 A1 | 6/2013 |
| WO | 2013148177 A1 | 10/2013 |
| WO | 2014052457 A1 | 4/2014 |
| WO | 2014086890 A1 | 6/2014 |
| WO | 2014122227 A2 | 8/2014 |
| WO | 2014122328 A1 | 8/2014 |
| WO | 2014146135 A2 | 9/2014 |
| WO | 2014172055 A2 | 10/2014 |
| WO | 2014/191580 A1 | 12/2014 |
| WO | 2014191581 A2 | 12/2014 |
| WO | 2014193888 A1 | 12/2014 |
| WO | 2014193889 A1 | 12/2014 |
| WO | 2014193934 A1 | 12/2014 |
| WO | 2015006764 A1 | 1/2015 |
| WO | 2015023928 A1 | 2/2015 |
| WO | 2015051454 A1 | 4/2015 |
| WO | 2015065650 A2 | 5/2015 |
| WO | 2015171555 A1 | 11/2015 |
| WO | 2016023844 A1 | 2/2016 |
| WO | 2016028899 A1 | 2/2016 |
| WO | 2016/038095 A2 | 3/2016 |
| WO | 2016043926 A1 | 3/2016 |
| WO | 2016054534 A1 | 4/2016 |
| WO | 2016054548 A1 | 4/2016 |
| WO | 2016/086233 A1 | 6/2016 |
| WO | 2016100689 A1 | 6/2016 |
| WO | 2016/120486 A1 | 8/2016 |
| WO | 2016156616 A1 | 10/2016 |
| WO | 2017095932 A1 | 6/2017 |
| WO | 2018/164747 A1 | 9/2018 |

OTHER PUBLICATIONS

International Search Report of International Patent Application No. PCT/EP2016/057360 dated Jun. 16, 2016.

Chaturvedula, Venkata Sai Prakash et al. "Additional Minor Diterpene Glycosides from Stevia rebaudiana", Natural Product Communications, 2011, pp. 1059-1062, vol. 6, No. 8.

Chaturvedula, Venkata Sai Prakash et al, "Minor diterpenoid glycosides from the leaves of Stevia rebaudiana," Phytochemistry Letters, 2011, pp. 209-212, vol. 4.

Chaturvedula, Venkata Sai Prakash et al., "Structure of the novel [alpha]-glucosyl linked diterpene glycosides from Stevia rebaudiana," Carbohydrate Research, 2011, pp. 2034-2038, vol. 346.

Chaturvedula, Venkata Sai Prakash et al., "Structures of the novel diterpene glycosides from Stevia rebaudiana," Carbohydrate Research, 2011, pp. 1057-1060, vol. 346.

Chaturvedula, Venkata Sai Prakash et al., "Utilization of RP-HPLC fingerprinting analysis for identification of diterpene glycosides from stevia rebaudinana," International Journal of Research in Phytochemistry & Pharmacology, 2011, pp. 88-92, vol. 1, No. 2.

Chaturvedula, Venkata Sai Prakash et al., "A new diterpene glycoside from Stevia rebaudiana," Molecules, 2011, pp. 2937-2943, vol. 16.

Chaturvedula, Venkata Sai Prakash et al., "Diterpene Glycosides from Stevia rebaudiana," Molecules, 2011, pp. 3552-3562, vol. 16.

Chaturvedula, Venkata Sai Prakash et al., "IR Spectral Analysis of Diterpene Glycosides Isolated from Stevia rebaudiana," Food and Nutrition Sciences, 2012, pp. 1467-1471, vol. 3.

Chaturvedula, Venkata Sai Prakash et al., "NMR Spectral Analysis and Hydrolysis Studies of Rebaudioside N, a Minor Steviol Glycoside of Stevia rebaudiana Bertoni," Food and Nutrition Sciences, 2013, pp. 1004-1008, vol. 4.

Chaturvedula, Venkata Sai Prakash, "Isolation and Structural Characterization of a New Minor Penta β-D-Glucopyranosyl Diterpene from Stevia rebaudiana Bertoni," American Journal of Plant Sciences, 2014, pp. 3519-3525, vol. 5.

EFSA Panel on Food Additives and Nutrient Sources added to Food (ANS), "Scientific Opinion on the safety of steviol glycosides for the proposed uses as a food additive," EFSA Journal 8(4):1537 (2010).

EFSA Panel on Food Additives and Nutrient Sources added to Food, "Scientific opinion on the safety of the proposed amendment of the specifications for steviol glycosides (E 960) as a food additive," EFSA Journal 13(12):4316.

EFSA Panel on Food Additives and Nutrient Sources added to Food (ANS), "Scientific opinion on the safety of the extension of use of steviol glycosides (E 960) as a food additive," EFSA Journal 13(6):4146 (2015).

FDA GRAS Notice (GRN) No. 626; http://www.fda.gov/Food/IngredientsPackagingLabeling/GRAS/NoticeInvtentory/default.htm. (68 pages)(2016).

(56) References Cited

OTHER PUBLICATIONS

Hsu, Che-Hsiung et al., "Toward Automated Oligosaccharide Synthesis," Angewandte Chemie Int. Ed., 2011, p. 11872-11923, vol. 50.

Ibrahim, Mohamed A. et al., "Minor Diterpene Glycosides from the Leaves of Stevia rebaudiana," Journal of Natural Products, 2014, 1231-1235, vol. 77.

Kusama, Satoru et al., "Transglucosylation into stevioside by the enzyme system from *Streptomyces* sp.," Agricultural and Biological Chemistry, Oct. 1986, pp. 2445-2451, vol. 50, No. 10.

Prakash, Indra et al., "Catalytic hydrogenation of the sweet principles of Stevia rebaudiana, Rebaudioside B, Rebaudioside C, and Rebaudioside D and sensory evaluation of their reduced derivatives," International Journal of Molecular Sciences, 2012, p. 15126-15136, vol. 13, No. 11.

Prakash, Indra et al., "Stability of rabaudioside A under acidic conditions and its degradation products," Food Research International, 2012, pp. 65-75, vol. 48.

Prakash, Indra et al., "Isolation, characterization and sensory evaluation of a Hexa β-D-glucopyranosyl diterpene from Stevia rebaudiana," Natural Product Communications, 2013, pp. 1523-1526, vol. 8, No. 11.

Prakash, Indra et al., "Additional Minor Diterpene Glycosides from Stevia rebaudiana Bertoni," Molecules, 2013, p. 13510-13519, vol. 18.

Chaturvedula, Venkata Sai Prakash and Prakash, Indra et al., "Structural Characterization and Hydrolysis Studies of Rebaudioside E, A Minor Sweet Component of Stevia Rebaudiana," European Chemical Bulletin, 2013, pp. 298-302, vol. 2, No. 5.

Prakash, Indra et al., "Development of Next Generation Stevia Sweetener: Rebaudioside M," Foods, 2014, pp. 162-175, vol. 3.

Prakash, Indra et al., "Bioconversion of Rebaudioside I from Rebaudioside A," Molecules, 2014, p. 17345-17355, vol. 19.

Prakash, Indra et al, "Isolation and Characterization of a Novel Rebaudioside M Isomer from a Bioconversion Reaction of Rebaudioside A and NMR Comparison Studies of Rebaudioside M Isolated from Stevia rebaudiana Bertoni and Stevia rebaudiana Morita," Biomolecules, 2014, pp. 374-389, vol. 4, No. 2.

Prakash, Indra et al, "Structural Characterization of the Degradation Products of a Minor Natural Sweet Diterpene Glycoside Rebaudioside M under Acidic Conditions," International Journal of Molecular Sciences, 2014, pp. 1014-1025, vol. 15.

Prakash, Indra et al., "A New Diterpene Glycoside: 15α-Hydroxy-Rebaudioside M Isolated from Stevia rebaudiana," Natural Product Communications, 2015, pp. 1159-1161, vol. 10, No. 7.

Starratt, Alvin N. et al., "Rebaudioside F, a diterpene glycoside from Stevia rebaudiana", Phytochemistry, 2002, pp. 367-370, vol. 59.

Verduyn, Cornelis et al., "Effect of benzoic acid on metabolic fluxes in yeasts: a continuous-culture study on the regulation of respiration and alcoholic fermentation," Yeast, 1992, pp. 501-517, vol. 8.

Praksh, I. et al., "Stability of rebaudioside A under acidic conditions and its degradation products", Food Research International, 2012, XP-002717610.

"Chemistry Glossary", Epimer @ Chemistry Dictionary & Glossary, Jan. 21, 2021, pp. 1-2, [retrieved online at http://glossary.periodni.com/glossary.php?en=epimer].

Bautista, Vanesa et al., "Cyclodextrin glycosyltransferase: a key enzyme in the assimilation of starch by the halophilic archaeon Haloferax mediterranei", Extremophiles, 2012, pp. 147-159, vol. 16.

Le, Anh S. and Mulderrig, Kathleen Bowe, "Sorbitol and Mannitol", Alternative Sweeteners: Third Edition, Revised and Expanded, Chapter 18, 2001, pp. 317-334.

\* cited by examiner
† cited by third party

STEVIOL GLYCOSIDES

CROSS-REFERENCE TO RELATED APPLICATIONS

This application is a National Stage entry of International Application No. PCT/EP2016/057360, filed 4 Apr. 2016, which claims priority to U.S. Provisional Application No. 62/142,631, filed 3 Apr. 2015.

REFERENCE TO SEQUENCE LISTING SUBMITTED AS A COMPLIANT ASCII TEXT FILE (.txt)

Pursuant to the EFS-Web legal framework and 37 CFR §§ 1.821-825 (see MPEP § 2442.03(a)), a Sequence Listing in the form of an ASCII-compliant text file (entitled "Sequence_Listing_2919208-319001_ST25.txt" created on 20 Sep. 2017, and 1,036,000 bytes in size) is submitted concurrently with the instant application, and the entire contents of the Sequence Listing are incorporated herein by reference.

FIELD OF THE INVENTION

The present invention relates to steviol glycosides, to methods for producing them, to sweetener compositions, flavour compositions, foodstuffs, feeds and beverages comprising the steviol glycosides and to use of the steviol glycosides in sweetener compositions, flavour compositions, foodstuffs, feeds and beverages.

BACKGROUND TO THE INVENTION

The leaves of the perennial herb, *Stevia rebaudiana* Bert., accumulate quantities of intensely sweet compounds known as steviol glycosides. Whilst the biological function of these compounds is unclear, they have commercial significance as alternative high potency sweeteners.

These sweet steviol glycosides have functional and sensory properties that appear to be superior to those of many high potency sweeteners. In addition, studies suggest that stevioside can reduce blood glucose levels in Type II diabetics and can reduce blood pressure in mildly hypertensive patients.

Steviol glycosides accumulate in *Stevia* leaves where they may comprise from 10 to 20% of the leaf dry weight. Stevioside and rebaudioside A are both heat and pH stable and suitable for use in carbonated beverages and many other foods. Stevioside is between 110 and 270 times sweeter than sucrose, rebaudioside A between 150 and 320 times sweeter than sucrose. In addition, rebaudioside D is also a high-potency diterpene glycoside sweetener which accumulates in *Stevia* leaves. It may be about 200 times sweeter than sucrose. Rebaudioside M is a further high-potency diterpene glycoside sweetener. It is present in trace amounts in certain *stevia* variety leaves, but has been suggested to have a superior taste profile.

Steviol glycosides have traditionally been extracted from the *Stevia* plant. In *Stevia*, (−)-kaurenoic acid, an intermediate in gibberellic acid (GA) biosynthesis, is converted into the tetracyclic dipterepene steviol, which then proceeds through a multi-step glycosylation pathway to form the various steviol glycosides. However, yields may be variable and affected by agriculture and environmental conditions. Also, *Stevia* cultivation requires substantial land area, a long time prior to harvest, intensive labour and additional costs for the extraction and purification of the glycosides.

There is though a need for additional steviol glycosides having alternative and/or improved taste profiles since different steviol glycosides may be better suited to different applications.

SUMMARY OF THE INVENTION

The present invention is based on the identification of new steviol glycosides in fermentation broths obtained from microorganisms which have been modified so as to produce steviol glycosides, including rebA. The new steviol glycosides will have different sensory properties as compared with known steviol glycosides. They may be used alone or in combination with other steviol glycosides, in particular as sweeteners or in sweetener compositions.

Accordingly, the invention relates to:

a steviol glycoside having the formula of (I)

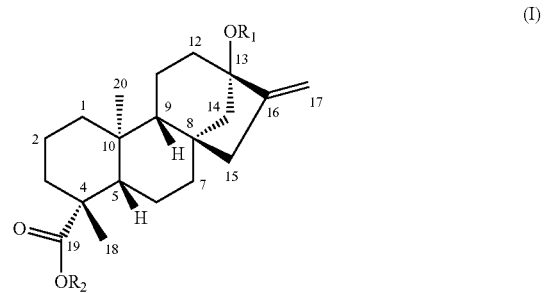

(I)

wherein at least 3 sugar moieties are present at position $R_1$ and at least three sugar moieties are present at position $R_2$ and wherein the steviol glycoside comprises at least seven sugar moieties all of which are linked, directly or indirectly, to the steviol aglycon by β-linkages;

a steviol glycoside having the formula of (I)

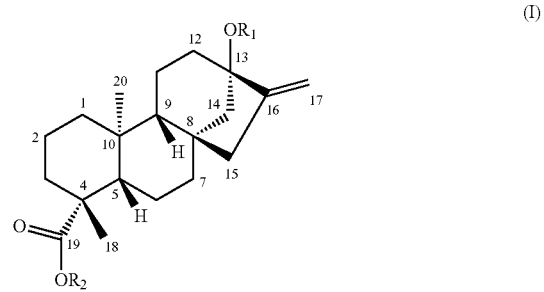

(I)

wherein at least 4 sugar moieties are present at positions $R_1$ and at least three sugar moieties are present at position $R_2$;

a steviol glycoside having the formula of (I)

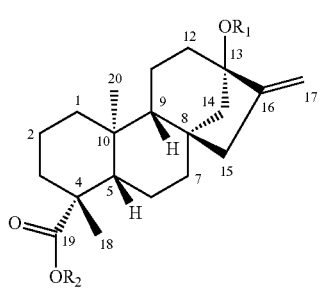

(I)

wherein at least 3 sugar moieties are present at position $R_1$ and at least three sugar moieties are present at position $R_2$, wherein the steviol glycoside comprises at least seven sugar moieties and wherein at least one of the sugars present at position $R_1$ is linked to the steviol aglycon or to a sugar molecule by a α-linkage;

a steviol glycoside having the formula of (I)

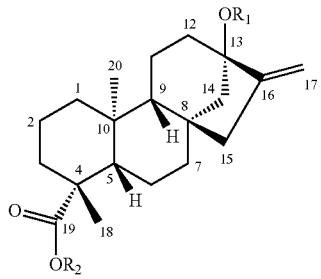

(I)

wherein at least 3 sugar moieties are present at position $R_1$ and at least four sugar moieties are present at position $R_2$, wherein at least four of the sugar moieties present at position $R_2$ are glucose moieties;

a steviol glycoside having the formula (II)

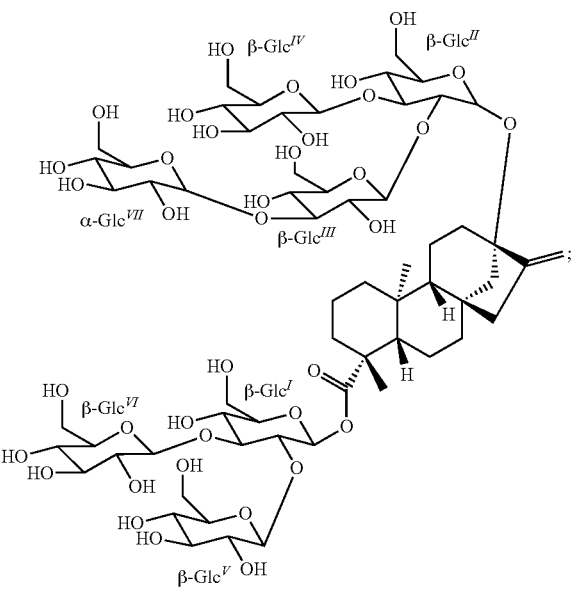

(II)

a steviol glycoside having the formula (III)

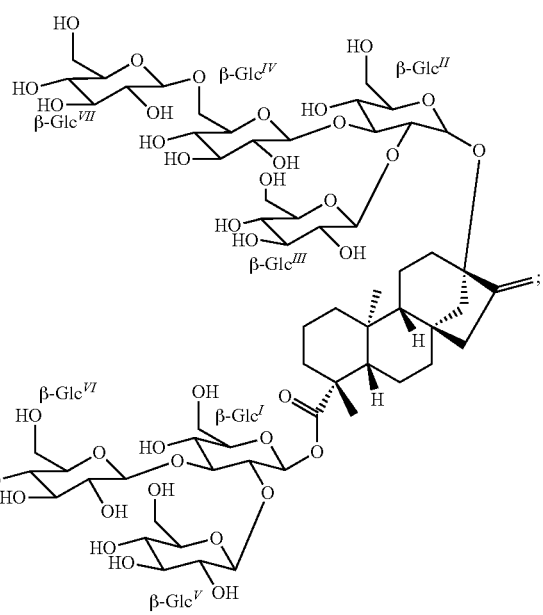

(III)

a steviol glycoside having the formula (IV)

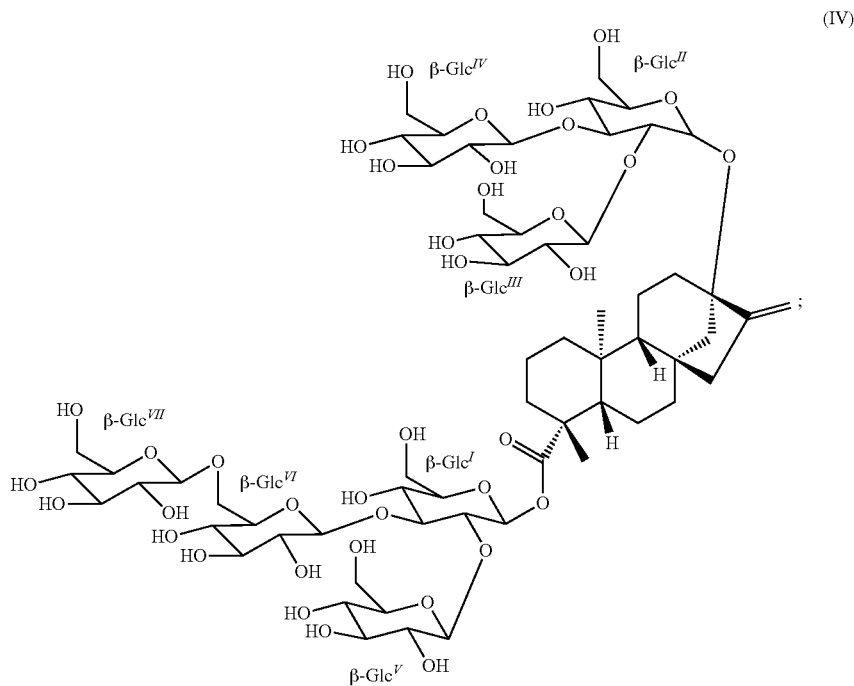

a fermentatively produced steviol glycoside having the formula of (I)

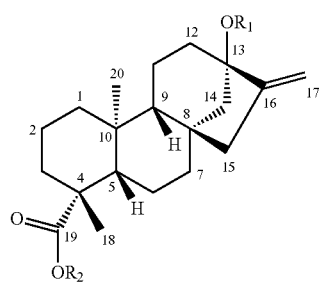

wherein at least 3 sugar moieties are present at position $R_1$ and at least three sugar moieties are present at position $R_2$ and wherein the steviol glycoside comprises at least seven sugar moieties;

a method for the production of a steviol glycoside according to any one of the preceding claims, which method comprises:

providing a recombinant yeast cell comprising recombinant nucleic acid sequences encoding polypeptides comprising the amino acid sequences encoded by: SEQ ID NO: 61, SEQ ID NO: 65, SEQ ID NO: 23, SEQ ID NO: 33, SEQ ID NO: 77, SEQ ID NO: 71, SEQ ID NO: 87, SEQ ID NO: 73 and SEQ ID NO: 75;

fermenting the recombinant yeast cell in a suitable fermentation medium; and, optionally, recovering a steviol glycoside according to any one of the preceding claims.

a composition comprising a steviol glycoside of the invention and one or more different steviol glycosides (which different steviol glycosides may or may not be a steviol glycoside of the invention);

a sweetener composition, flavor composition, foodstuff, feed or beverage which comprises a steviol glycoside or a composition of the invention;

use of a steviol glycoside or a composition of the invention in a sweetener composition or flavor composition; and use of a steviol glycoside or a composition of the invention in a foodstuff, feed or beverage.

DESCRIPTION OF THE SEQUENCE LISTING

Figure 1:
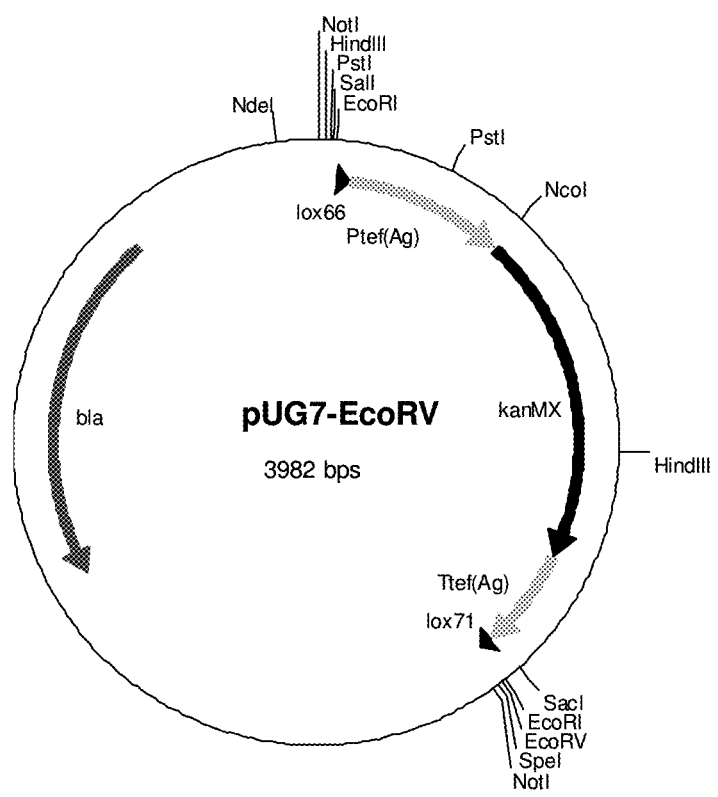
FIG. 1 sets out a schematic representation of the plasmid pUG7-EcoRV.

A description of the sequences is set out in Table 15. Sequences described herein may be defined with reference to the sequence listing or with reference to the database accession numbers also set out in Table 15.

DETAILED DESCRIPTION OF THE INVENTION

Throughout the present specification and the accompanying claims, the words "comprise", "include" and "having" and variations such as "comprises", "comprising", "includes" and "including" are to be interpreted inclusively. That is, these words are intended to convey the possible inclusion of other elements or integers not specifically recited, where the context allows.

The articles "a" and "an" are used herein to refer to one or to more than one (i.e. to one or at least one) of the grammatical object of the article. By way of example, "an element" may mean one element or more than one element.

This invention relates to steviol glycosides. For the purposes of this invention, a steviol glycosides is a glycoside of steviol, specifically a steviol molecule with its carboxyl hydrogen atom replaced by a glucose molecule to form an ester, and an hydroxyl hydrogen with glucose to form an acetal.

A steviol glycoside of the invention may be provided in isolated form. An "isolated steviol glycoside" is a substance removed from other material, such as other steviol glycosides, with which it may be naturally associated. Thus, an isolated steviol glycoside may contain at most 10%, at most 8%, more preferably at most 6%, more preferably at most 5%, more preferably at most 4%, more preferably at most 3%, even more preferably at most 2%, even more preferably at most 1% and most preferably at most 0.5% by weight of other material, for example other steviol glycosides, with which it is naturally associated. The isolated steviol glycosides may be free of any other impurities. The isolated steviol glycoside of the invention may be at least 50% pure, e.g., at least 60% pure, at least 70% pure, at least 75% pure, at least 80% pure, at least 85% pure, at least 90% pure, or at least 95%, 96%, 97%, 98%, 99%, 99.5%, 99.9% pure by weight.

The invention provides a steviol glycoside having the formula of (I)

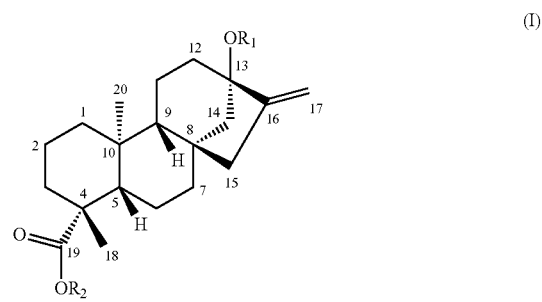

(I)

wherein at least 3 sugar moieties are present at position $R_1$ and at least three sugar moieties are present at position $R_2$ and wherein the steviol glycoside comprises at least seven sugar moieties all of which are linked, directly or indirectly, to the steviol aglycon by β-linkages, or wherein at least 4 sugar moieties are present at positions $R_1$ and at least three sugar moieties are present at position $R_2$, or wherein at least 3 sugar moieties are present at position $R_1$ and at least three sugar moieties are present at position $R_2$, wherein the steviol glycoside comprises at least seven sugar moieties and wherein at least one of the sugars present at position $R_1$ is linked to the steviol aglycon or to a sugar molecule by a α-linkage, or wherein at least 3 sugar moieties are present at position $R_1$ and at least four sugar moieties are present at position $R_2$, wherein at least four of the sugar moieties present at position $R_2$ are glucose moieties.

The invention also provides steviol glycosides having the formula (II), (III) or (IV):

(II)
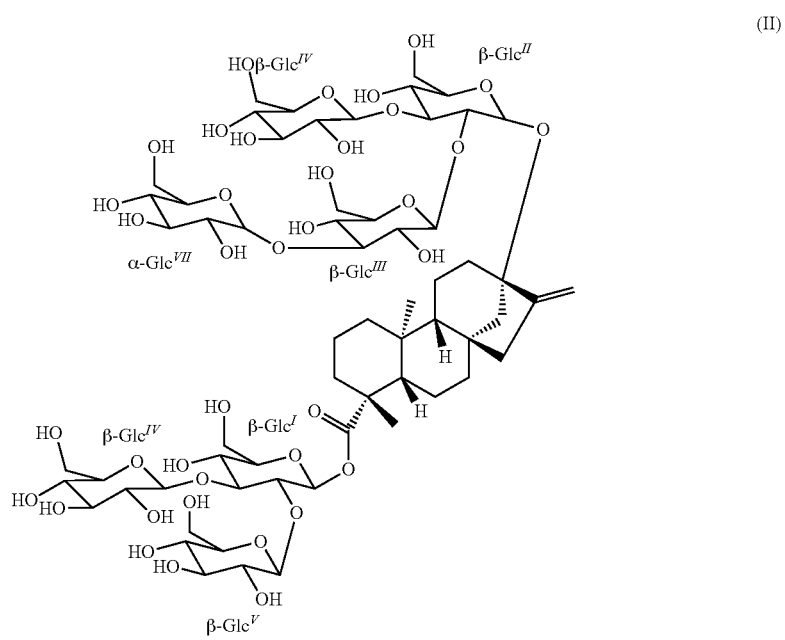
(III)
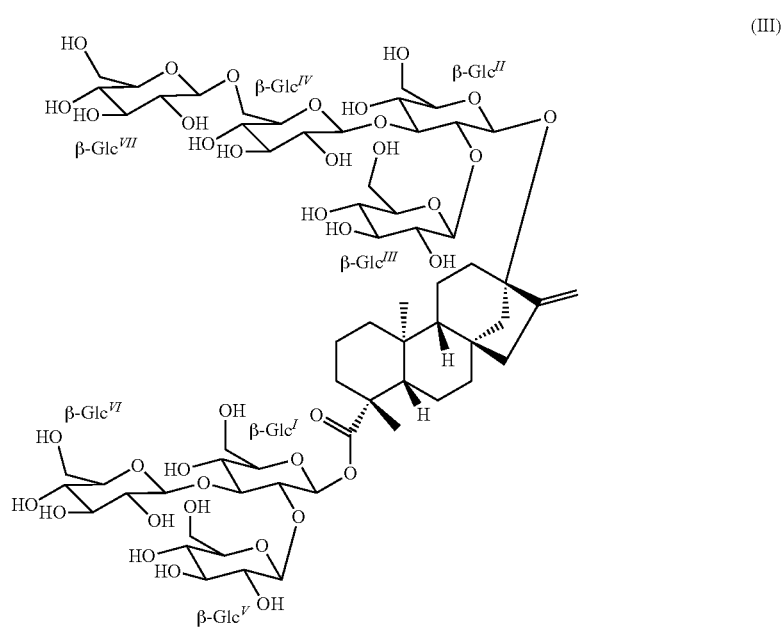

-continued

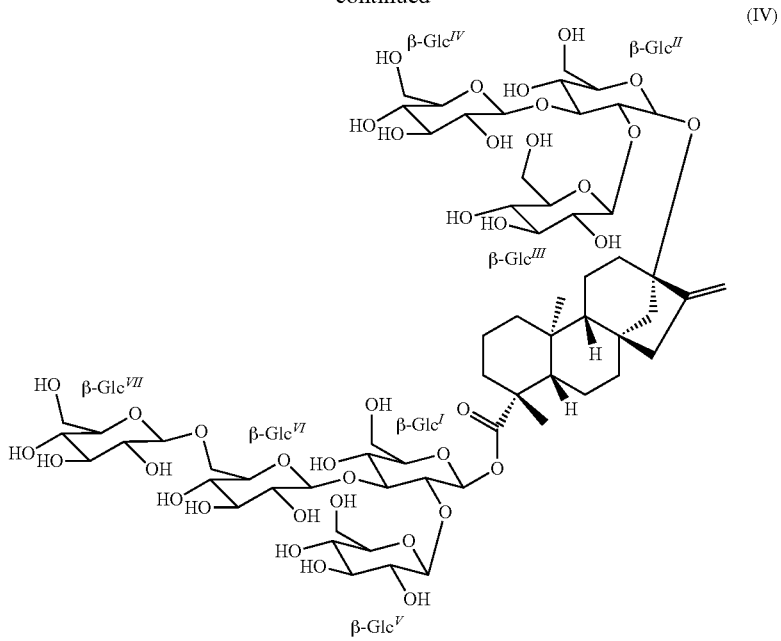

(IV)

A steviol glycoside of the invention may be obtained from plant material, but more typically will be obtained by fermentative production, for example via fermentation of a recombinant host cell, such as a yeast cell.

Thus, the invention provides a fermentatively produced steviol glycoside having the formula of (I)

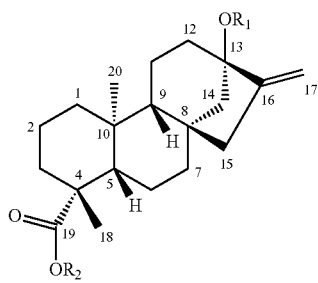

(I)

wherein at least 3 sugar moieties are present at position $R_1$ and at least three sugar moieties are present at position $R_2$ and wherein the steviol glycoside comprises at least seven sugar moieties.

One may distinguish between α- and β-glycosidic bonds based on the relative stereochemistry (R or S) of the anomeric position and the stereocentre furthest from C1 in a saccharide. Typically, an α-glycosidic bond is formed when both carbons have the same stereochemistry, whereas a β-glycosidic bond occurs when the two carbons have different stereochemistry Such a fermentatively-produced steviol glycoside may have a structure of any of the steviol glycosides described herein.

The invention further relates to a method for the production of a steviol glycoside. In such a method, a suitable recombinant host cell, such as a yeast cell, is fermented in a suitable fermentation medium such that the steviol glycoside is produced. Optionally, the steviol glycoside may be recovered.

For example, a method for the production of a steviol glycoside as described herein may comprise:

providing a recombinant yeast cell comprising recombinant nucleic acid sequences encoding polypeptides comprising the amino acid sequences encoded by: SEQ ID NO: 61, SEQ ID NO: 65, SEQ ID NO: 23, SEQ ID NO: 33, SEQ ID NO: 77, SEQ ID NO: 71, SEQ ID NO: 87, SEQ ID NO: 73 and SEQ ID NO: 75;

fermenting the recombinant yeast cell in a suitable fermentation medium; and, optionally, recovering a steviol glycoside as described herein.

The term "recombinant" when used in reference to a cell, nucleic acid, protein or vector, indicates that the cell, nucleic acid, protein or vector, has been modified by the introduction of a heterologous nucleic acid or protein or the alteration of a native nucleic acid or protein, or that the cell is derived from a cell so modified. Thus, for example, recombinant cells express genes that are not found within the native (non-recombinant) form of the cell or express native genes that are otherwise abnormally expressed, under expressed or not expressed at all. The term "recombinant" is synonymous with "genetically modified".

A recombinant yeast cell used in a process of the invention may be any suitable yeast cell. Preferred recombinant yeast cells may be selected from the genera: *Saccharomyces* (e.g., *S. cerevisiae, S. bayanus, S. pastorianus, S. carlsbergensis*), *Brettanomyces, Kluyveromyces, Candida* (e.g., *C. krusei, C. revkaufi, C. pulcherrima, C. tropicalis, C. utilis*), *Issatchenkia* (eg. *I. orientalis*) *Pichia* (e.g., *P. pastoris*), *Schizosaccharomyces, Hansenula, Kloeckera, Pachysolen, Schwanniomyces, Trichosporon, Yarrowia* (e.g., *Y. lipolytica* (formerly classified as *Candida lipolytica*)) or *Yamadazyma*. Preferably, the recombinant yeast cell is a *Saccharomyces cerevisiae, Yarrowia lipolytica* or *Issatchenkia orientalis* cell.

A recombinant yeast cell for use in a method according to the invention may comprise one or more recombinant nucleotide sequence(s) encoding one of more of:

a polypeptide having ent-copalyl pyrophosphate synthase activity;
a polypeptide having ent-Kaurene synthase activity;
a polypeptide having ent-Kaurene oxidase activity; and
a polypeptide having kaurenoic acid 13-hydroxylase activity.

For the purposes of this invention, a polypeptide having ent-copalyl pyrophosphate synthase (EC 5.5.1.13) is capable of catalyzing the chemical reation:

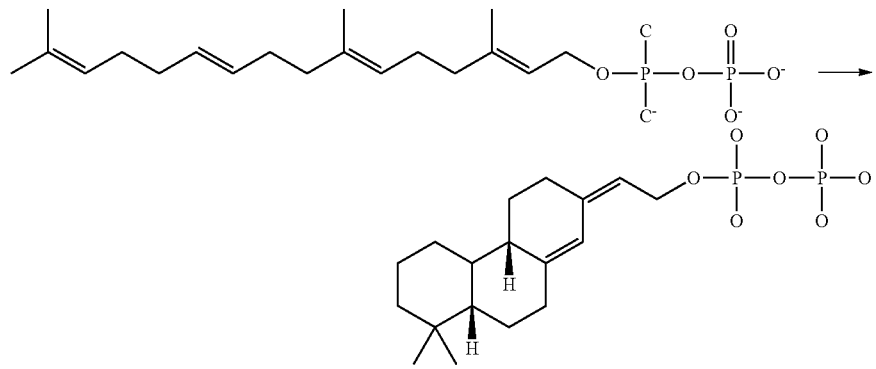

This enzyme has one substrate, geranylgeranyl pyrophosphate, and one product, ent-copalyl pyrophosphate. This enzyme participates in gibberellin biosynthesis. This enzyme belongs to the family of isomerase, specifically the class of intramolecular lyases. The systematic name of this enzyme class is ent-copalyl-diphosphate lyase (decyclizing). Other names in common use include having ent-copalyl pyrophosphate synthase, ent-kaurene synthase A, and ent-kaurene synthetase A.

Suitable nucleic acid sequences encoding an ent-copalyl pyrophosphate synthase may for instance comprise a sequence as set out in SEQ ID. NO: 1, 3, 5, 7, 17, 19, 59, 61, 141, 142, 151, 152, 153, 154, 159, 160, 182 or 184.

For the purposes of this invention, a polypeptide having ent-kaurene synthase activity (EC 4.2.3.19) is a polypeptide that is capable of catalyzing the chemical reaction:

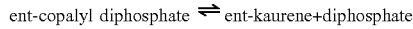

ent-copalyl diphosphate ⇌ ent-kaurene+diphosphate

Hence, this enzyme has one substrate, ent-copalyl diphosphate, and two products, ent-kaurene and diphosphate.

This enzyme belongs to the family of lyases, specifically those carbon-oxygen lyases acting on phosphates. The systematic name of this enzyme class is ent-copalyl-diphosphate diphosphate-lyase (cyclizing, ent-kaurene-forming). Other names in common use include ent-kaurene synthase B, ent-kaurene synthetase B, ent-copalyl-diphosphate diphosphate-lyase, and (cyclizing). This enzyme participates in diterpenoid biosynthesis.

Suitable nucleic acid sequences encoding an ent-Kaurene synthase may for instance comprise a sequence as set out in SEQ ID. NO: 9, 11, 13, 15, 17, 19, 63, 65, 143, 144, 155, 156, 157, 158, 159, 160, 183 or 184.

ent-copalyl diphosphate synthases may also have a distinct ent-kaurene synthase activity associated with the same protein molecule. The reaction catalyzed by ent-kaurene synthase is the next step in the biosynthetic pathway to gibberellins. The two types of enzymic activity are distinct, and site-directed mutagenesis to suppress the ent-kaurene synthase activity of the protein leads to build up of ent-copalyl pyrophosphate.

Accordingly, a single nucleotide sequence used in a recombinant yeast suitable for use in the method of the invention may encode a polypeptide having ent-copalyl pyrophosphate synthase activity and ent-kaurene synthase activity. Alternatively, the two activities may be encoded two distinct, separate nucleotide sequences.

For the purposes of this invention, a polypeptide having ent-kaurene oxidase activity (EC 1.14.13.78) is a polypeptide which is capable of catalysing three successive oxidations of the 4-methyl group of ent-kaurene to give kaurenoic acid. Such activity typically requires the presence of a cytochrome P450.

Suitable nucleic acid sequences encoding an ent-Kaurene oxidase may for instance comprise a sequence as set out in SEQ ID. NO: 21, 23, 25, 67, 85, 145, 161, 162, 163, 180 or 186.

For the purposes of the invention, a polypeptide having kaurenoic acid 13-hydroxylase activity (EC 1.14.13) is one which is capable of catalyzing the formation of steviol (ent-kaur-16-en-13-ol-19-oic acid) using NADPH and $O_2$. Such activity may also be referred to as ent-ka 13-hydroxylase activity.

Suitable nucleic acid sequences encoding a kaurenoic acid 13-hydroxylase may for instance comprise a sequence as set out in SEQ ID. NO: 27, 29, 31, 33, 69, 89, 91, 93, 95, 97, 146, 164, 165, 166, 167 or 185.

A recombinant yeast cell suitable for use in the method of the invention may comprise a recombinant nucleic acid sequence encoding a polypeptide having NADPH-cytochrome p450 reductase activity. That is to say, a recombinant yeast suitable for use in a method of the invention may be capable of expressing a nucleotide sequence encoding a polypeptide having NADPH-cytochrome p450 reductase activity. For the purposes of the invention, a polypeptide having NADPH-Cytochrome P450 reductase activity (EC 1.6.2.4; also known as NADPH:ferrihemoprotein oxidoreductase, NADPH:hemoprotein oxidoreductase, NADPH:P450 oxidoreductase, P450 reductase, POR, CPR, CYPOR) is typically one which is a membrane-bound enzyme allowing electron transfer to cytochrome P450 in the microsome of the eukaryotic cell from a FAD- and FMN-containing enzyme NADPH:cytochrome P450 reductase (POR; EC 1.6.2.4).

Suitable nucleic acid sequences encoding a NADPH-cytochrome p450 reductase may for instance comprise a sequence as set out in SEQ ID. NO: 53, 55, 57 or 77.

A recombinant yeast cell suitable for use in a method of the invention may also comprise one or more recombinant nucleic acid sequences encoding one or more of:

(i) a polypeptide having UGT74G1 activity;
(ii) a polypeptide having UGT2 activity;
(iii) a polypeptide having UGT85C2 activity; and
(iv) a polypeptide having UGT76G1 activity.

A recombinant yeast suitable for use in the invention may comprise a nucleotide sequence encoding a polypeptide capable of catalyzing the addition of a C-13-glucose to steviol. That is to say, a recombinant yeast suitable for use in a method of the invention may comprise a UGT which is capable of catalyzing a reaction in which steviol is converted to steviolmonoside.

Such a recombinant yeast suitable for use in a method of the invention may comprise a nucleotide sequence encoding a polypeptide having the activity shown by UDP-glycosyltransferase (UGT) UGT85C2, whereby the nucleotide sequence upon transformation of the yeast confers on that yeast the ability to convert steviol to steviolmonoside.

UGT85C2 activity is transfer of a glucose unit to the 13-OH of steviol. Thus, a suitable UGT85C2 may function as a uridine 5'-diphospho glucosyl: steviol 13-OH transferase, and a uridine 5'-diphospho glucosyl: steviol-19-0-glucoside 13-OH transferase. A functional UGT85C2 polypeptides may also catalyze glucosyl transferase reactions that utilize steviol glycoside substrates other than steviol and steviol-19-O-glucoside. Such sequences may be referred to as UGT1 sequences herein.

A recombinant yeast suitable for use in the invention may comprise a nucleotide sequence encoding a polypeptide which has UGT2 activity.

A polypeptide having UGT2 activity is one which functions as a uridine 5'-diphospho glucosyl: steviol-13-O-glucoside transferase (also referred to as a steviol-13-monoglucoside 1,2-glucosylase), transferring a glucose moiety to the C-2' of the 13-O-glucose of the acceptor molecule, steviol-13-O-glucoside. Typically, a suitable UGT2 polypeptide also functions as a uridine 5'-diphospho glucosyl: rubusoside transferase transferring a glucose moiety to the C-2' of the 13-O-glucose of the acceptor molecule, rubusoside.

A polypeptide having UGT2 activity may also catalyze reactions that utilize steviol glycoside substrates other than steviol-13-0-glucoside and rubusoside, e.g., functional UGT2 polypeptides may utilize stevioside as a substrate, transferring a glucose moiety to the C-2' of the 19-O-glucose residue to produce rebaudioside E. A functional UGT2 polypeptides may also utilize rebaudioside A as a substrate, transferring a glucose moiety to the C-2' of the 19-O-glucose residue to produce rebaudioside D. However, a functional UGT2 polypeptide typically does not transfer a glucose moiety to steviol compounds having a 1,3-bound glucose at the C-13 position, i.e., transfer of a glucose moiety to steviol 1,3-bioside and 1,3-stevioside typically does not occur.

A polypeptide having UGT2 activity may also transfer sugar moieties from donors other than uridine diphosphate glucose. For example, a polypeptide having UGT2 activity act as a uridine 5'-diphospho D-xylosyl: steviol-13-O-glucoside transferase, transferring a xylose moiety to the C-2' of the 13-O-glucose of the acceptor molecule, steviol-13-O-glucoside. As another example, a polypeptide having UGT2 activity may act as a uridine 5'-diphospho L-rhamnosyl: steviol-13-0-glucoside transferase, transferring a rhamnose moiety to the C-2' of the 13-O-glucose of the acceptor molecule, steviol.

A recombinant yeast suitable for use in the method of the invention may comprise a nucleotide sequence encoding a polypeptide having UGT activity may comprise a nucleotide sequence encoding a polypeptide capable of catalyzing the addition of a C-19-glucose to steviolbioside. That is to say, a recombinant yeast of the invention may comprise a UGT which is capable of catalyzing a reaction in which steviolbioside is converted to stevioside. Accordingly, such a recombinant yeast may be capable of converting steviolbioside to stevioside. Expression of such a nucleotide sequence may confer on the recombinant yeast the ability to produce at least stevioside.

A recombinant yeast suitable for use in a method of the invention may thus also comprise a nucleotide sequence encoding a polypeptide having the activity shown by UDP-glycosyltransferase (UGT) UGT74G1, whereby the nucleotide sequence upon transformation of the yeast confers on the cell the ability to convert steviolbioside to stevioside.

Suitable UGT74G1 polypeptides may be capable of transferring a glucose unit to the 13-OH or the 19-COOH, respectively, of steviol. A suitable UGT74G1 polypeptide may function as a uridine 5'-diphospho glucosyl: steviol 19-COOH transferase and a uridine 5'-diphospho glucosyl: steviol-13-O-glucoside 19-COOH transferase. Functional UGT74G1 polypeptides also may catalyze glycosyl transferase reactions that utilize steviol glycoside substrates other than steviol and steviol-13-O-glucoside, or that transfer sugar moieties from donors other than uridine diphosphate glucose. Such sequences may be referred to herein as UGT3 sequences.

A recombinant yeast suitable for use in a method the invention may comprise a nucleotide sequence encoding a polypeptide capable of catalyzing glucosylation of the C-3' of the glucose at the C-13 position of stevioside. That is to say, a recombinant yeast suitable for use in a method of the invention may comprise a UGT which is capable of catalyzing a reaction in which stevioside is converted to rebaudioside A. Accordingly, such a recombinant yeast may be capable of converting stevioside to rebaudioside A. Expression of such a nucleotide sequence may confer on the yeast the ability to produce at least rebaudioside A.

A recombinant yeast suitable for use in a method of the invention may thus also comprise a nucleotide sequence encoding a polypeptide having the activity shown by UDP-glycosyltransferase (UGT) UGT76G1, whereby the nucleotide sequence upon transformation of a yeast confers on that yeast the ability to convert stevioside to rebaudioside A.

A suitable UGT76G1 adds a glucose moiety to the C-3' of the C-13-O-glucose of the acceptor molecule, a steviol 1,2 glycoside. Thus, UGT76G1 functions, for example, as a uridine 5'-diphospho glucosyl: steviol 13-0-1,2 glucoside C-3' glucosyl transferase and a uridine 5'-diphospho glucosyl: steviol-19-0-glucose, 13-0-1,2 bioside C-3' glucosyl transferase. Functional UGT76G1 polypeptides may also catalyze glucosyl transferase reactions that utilize steviol glycoside substrates that contain sugars other than glucose, e.g., steviol rhamnosides and steviol xylosides. Such sequences may be referred to herein as UGT4 sequences. A UGT4 may alternatively or in addition be capable of converting RebD to RebM.

A recombinant yeast suitable for use in a method of the invention typically comprises nucleotide sequences encoding at least one polypeptide having UGT1 activity, at least one polypeptide having UGT2 activity, least one polypeptide having UGT3 activity and at least one polypeptide having UGT4 activity. One or more of these nucleic acid sequences may be recombinant. A given nucleic acid may encode a polypeptide having one or more of the above activities. For example, a nucleic acid encode for a polypeptide which has two, three or four of the activities set out above. Preferably, a recombinant yeast for use in the method of the invention comprises UGT1, UGT2 and UGT3 and UGT4 activity. Suitable UGT1, UGT2, UGT3 and UGT4 sequences are described in in Table 15 herein. A preferred combination of sequences encoding UGT1, 2, 3 and 4 activities is SEQ ID NOs: 71, 87, 73 and 75.

In the method of the invention, a recombinant host, such as a yeast, may be able to grow on any suitable carbon source known in the art and convert it to one or more steviol glycosides. The recombinant host may be able to convert directly plant biomass, celluloses, hemicelluloses, pectines, rhamnose, galactose, fucose, maltose, maltodextrines, ribose, ribulose, or starch, starch derivatives, sucrose, lactose and glycerol. Hence, a preferred host expresses enzymes such as cellulases (endocellulases and exocellulases) and hemicellulases (e.g. endo- and exo-xylanases, arabinases) necessary for the conversion of cellulose into glucose monomers and hemicellulose into xylose and arabinose monomers, pectinases able to convert pectines into glucuronic acid and galacturonic acid or amylases to convert starch into glucose monomers. Preferably, the host is able to convert a carbon source selected from the group consisting of glucose, xylose, arabinose, sucrose, lactose and glycerol. The host cell may for instance be a eukaryotic host cell as described in WO03/062430, WO06/009434, EP149970861, WO2006096130 or WO04/099381.

The fermentation medium used in the process for the production of a steviol glycoside of the invention may be any suitable fermentation medium which allows growth of a particular eukaryotic host cell. The essential elements of the fermentation medium are known to the person skilled in the art and may be adapted to the host cell selected.

Preferably, the fermentation medium comprises a carbon source selected from the group consisting of plant biomass, celluloses, hemicelluloses, pectines, rhamnose, galactose, fucose, fructose, maltose, maltodextrines, ribose, ribulose, or starch, starch derivatives, sucrose, lactose, fatty acids, triglycerides and glycerol. Preferably, the fermentation medium also comprises a nitrogen source such as ureum, or an ammonium salt such as ammonium sulphate, ammonium chloride, ammoniumnitrate or ammonium phosphate.

The fermentation process according to the present invention may be carried out in batch, fed-batch or continuous mode. A separate hydrolysis and fermentation (SHF) process or a simultaneous saccharification and fermentation (SSF) process may also be applied. A combination of these fermentation process modes may also be possible for optimal productivity. A SSF process may be particularly attractive if starch, cellulose, hemicelluose or pectin is used as a carbon source in the fermentation process, where it may be necessary to add hydrolytic enzymes, such as cellulases, hemicellulases or pectinases to hydrolyse the substrate.

The fermentation process for the production of a steviol glycoside according to the present invention may be an aerobic or an anaerobic fermentation process.

An anaerobic fermentation process may be herein defined as a fermentation process run in the absence of oxygen or in which substantially no oxygen is consumed, preferably less than 5, 2.5 or 1 mmol/L/h, and wherein organic molecules serve as both electron donor and electron acceptors. The fermentation process according to the present invention may also first be run under aerobic conditions and subsequently under anaerobic conditions.

The fermentation process may also be run under oxygen-limited, or micro-aerobical, conditions. Alternatively, the fermentation process may first be run under aerobic conditions and subsequently under oxygen-limited conditions. An oxygen-limited fermentation process is a process in which the oxygen consumption is limited by the oxygen transfer from the gas to the liquid. The degree of oxygen limitation is determined by the amount and composition of the ingoing gas flow as well as the actual mixing/mass transfer properties of the fermentation equipment used.

The production of a steviol glycoside in the process according to the present invention may occur during the growth phase of the host cell, during the stationary (steady state) phase or during both phases. It may be possible to run the fermentation process at different temperatures.

The process for the production of a steviol glycoside may be run at a temperature which is optimal for the recombinant host. The optimum growth temperature may differ for each transformed recombinant host and is known to the person skilled in the art. The optimum temperature might be higher than optimal for wild type organisms to grow the organism efficiently under non-sterile conditions under minimal infection sensitivity and lowest cooling cost. Alternatively, the process may be carried out at a temperature which is not optimal for growth of the recombinant host.

The process for the production of a steviol glycoside according to the present invention may be carried out at any suitable pH value. If the recombinant host is a yeast, the pH in the fermentation medium preferably has a value of below 6, preferably below 5.5, preferably below 5, preferably below 4.5, preferably below 4, preferably below pH 3.5 or below pH 3.0, or below pH 2.5, preferably above pH 2. An advantage of carrying out the fermentation at these low pH values is that growth of contaminant bacteria in the fermentation medium may be prevented.

Such a process may be carried out on an industrial scale. The product of such a process is one or more steviol glycosides according to the invention.

Recovery of steviol glycoside(s) of the invention from the fermentation medium may be performed by known methods in the art, for instance by distillation, vacuum extraction, solvent extraction, or evaporation.

In the process for the production of a steviol glycoside according to the invention, it may be possible to achieve a concentration of above 0.5 mg/I, preferably above about 1 mg/I.

In the event that one or more steviol glycosides of the invention is expressed within a recombinant host, such cells may need to be treated so as to release them.

The invention also provides a composition comprising a steviol glycoside of the invention in combination with one or more different steviol glycosides. One or more of the one or more different steviol glycosides may be a steviol glycoside of the invention. One or more of the one or more different steviol glycosides may be a glycosylated diterpene (i.e. a diterpene glycoside), such as steviolmonoside, steviolbioside, stevioside, rebaudioside A, rebaudioside B, rebaudioside C, rebaudioside D, rebaudioside E, rebaudioside F, rebaudioside M, rubusoside, dulcoside A, steviol-13-monoside, steviol-19-monoside or 13-[(β-D-Glucopyranosyl)oxy) kaur-16-en-18-oic acid 2-O-β-D-glucopyranosyl-p-D-glucopyranosyl ester.

A composition of the invention may comprise a relatively low amount of a steviol glycoside of the invention in combination with a greater amount of a different steviol glycoside.

For example, a composition of the invention may comprise at least about 80%, at least about 90%, at least about 95% rebaudioside A in combination with a steviol glycoside of the invention. A composition of the invention may comprise at least about 80%, at least about 90%, at least about 95% rebaudioside D in combination with a steviol glycoside of the invention. A composition of the invention may comprise at least about 80%, at least about 90%, at least about 95% rebaudioside M in combination with a steviol glycoside of the invention. A composition of the invention may comprise at least about 80%, at least about 90%, at least about 95% rebaudioside A in combination with a steviol glycoside of the invention and rebaudioside D. A composition of the invention may comprise at least about 80%, at least about 90%, at least about 95% rebaudioside A in combination with a steviol glycoside of the invention and rebaudioside M. Percentages referred to are on a dry weight basis.

A steviol glycoside according to the present invention may be used in any application known for such compounds. In particular, they may for instance be used as a sweetener or flavour, for example, in a food, feed or a beverage. For example steviol glycosides may be formulated in soft drinks such as carbonated beverages, as a tabletop sweetener, chewing gum, dairy product such as yoghurt (eg. plain yoghurt), cake, cereal or cereal-based food, nutraceutical, pharmaceutical, edible gel, confectionery product, cosmetic, toothpastes or other oral cavity composition, etc. In addition, a steviol glycoside can be used as a sweetener not only for drinks, foodstuffs, and other products dedicated for human consumption, but also in animal feed and fodder with improved characteristics.

Accordingly, the invention provides, inter alia, a sweetener composition, a flavor composition, a foodstuff, feed or beverage which comprises a steviol gylcoside prepared according to a process of the invention.

A composition of the invention may comprise one or more non-naturally occurring components.

Furthermore, the invention provides:
use of a steviol glycoside or a composition of the invention in a sweetener composition or flavor composition; and
use of a steviol glycoside or a composition of the invention in a foodstuff, feed or beverage.

During the manufacturing of foodstuffs, drinks, pharmaceuticals, cosmetics, table top products, chewing gum the conventional methods such as mixing, kneading, dissolution, pickling, permeation, percolation, sprinkling, atomizing, infusing and other methods can be used.

The steviol glycoside obtained in this invention can be used in dry or liquid forms. It can be added before or after heat treatment of food products. The amount of the sweetener depends on the purpose of usage. It can be added alone or in the combination with other compounds.

Compounds produced according to the method of the invention may be blended with one or more further non-calorific or calorific sweeteners. Such blending may be used to improve flavour or temporal profile or stability. The steviol glycoside of the invention may be used to improve the flavour or temporal profile or stability of a second steviol glycoside, such as rebaudiose A, D or M.

A wide range of both non-calorific and calorific sweeteners may be suitable for blending with a steviol glycoside of the invention, including one or more other steviol glycosides according to the invention or one or more other known steviol glycosides such as steviolmonoside, steviolbioside, stevioside, rebaudioside A, rebaudioside B, rebaudioside C, rebaudioside D, rebaudioside E, rebaudioside F, rebaudioside M, rubusoside, dulcoside A, steviol-13-monoside, steviol-19-monoside or 13-[(β-D-Glucopyranosyl)oxy)kaur-16-en-18-oic acid 2-O-β-D-glucopyranosyl-β-D-glucopyranosyl ester. Alternatively, or in addition, non-calorific sweeteners such as mogroside, monatin, aspartame, acesulfame salts, cyclamate, sucralose, saccharin salts or erythritol. Calorific sweeteners suitable for blending with steviol glycosides include sugar alcohols and carbohydrates such as sucrose, glucose, fructose and HFCS. Sweet tasting amino acids such as glycine, alanine or serine may also be used.

The steviol glycoside can be used in the combination with a sweetener suppressor, such as a natural sweetener suppressor. It may be combined with an umami taste enhancer, such as an amino acid or a salt thereof.

A steviol glycoside can be combined with a polyol or sugar alcohol, a carbohydrate, a physiologically active substance or functional ingredient (for example a carotenoid, dietary fiber, fatty acid, saponin, antioxidant, nutraceutical, flavonoid, isothiocyanate, phenol, plant sterol or stanol (phytosterols and phytostanols), a polyols, a prebiotic, a probiotic, a phytoestrogen, soy protein, sulfides/thiols, amino acids, a protein, a vitamin, a mineral, and/or a substance classified based on a health benefits, such as cardiovascular, cholesterol-reducing or anti-inflammatory.

A composition with a steviol glycoside may include a flavoring agent, an aroma component, a nucleotide, an organic acid, an organic acid salt, an inorganic acid, a bitter compound, a protein or protein hydrolyzate, a surfactant, a flavonoid, an astringent compound, a vitamin, a dietary fiber, an antioxidant, a fatty acid and/or a salt.

A steviol glycoside of the invention may be applied as a high intensity sweetener to produce zero calorie, reduced calorie or diabetic beverages and food products with improved taste characteristics. Also it can be used in drinks, foodstuffs, pharmaceuticals, and other products in which sugar cannot be used.

In addition, a steviol glycoside of the invention may be used as a sweetener not only for drinks, foodstuffs, and other products dedicated for human consumption, but also in animal feed and fodder with improved characteristics.

The examples of products where a steviol glycoside of the invention composition can be used as a sweetening compound can be as alcoholic beverages such as vodka, wine, beer, liquor, sake, etc; natural juices, refreshing drinks, carbonated soft drinks, diet drinks, zero calorie drinks, reduced calorie drinks and foods, yogurt drinks, instant juices, instant coffee, powdered types of instant beverages, canned products, syrups, fermented soybean paste, soy sauce, vinegar, dressings, mayonnaise, ketchups, curry, soup, instant bouillon, powdered soy sauce, powdered vinegar, types of biscuits, rice biscuit, crackers, bread, chocolates, caramel, candy, chewing gum, jelly, pudding, preserved fruits and vegetables, fresh cream, jam, marmalade, flower paste, powdered milk, ice cream, sorbet, vegetables and fruits packed in bottles, canned and boiled beans, meat and foods boiled in sweetened sauce, agricultural vegetable food products, seafood, ham, sausage, fish ham, fish sausage, fish paste, deep fried fish products, dried seafood products, frozen food products, preserved seaweed, preserved meat, tobacco, medicinal products, and many others. In principal it can have unlimited applications.

The sweetened composition comprises a beverage, non-limiting examples of which include non-carbonated and carbonated beverages such as colas, ginger ales, root beers, ciders, fruit-flavored soft drinks (e.g., citrus-flavored soft drinks such as lemon-lime or orange), powdered soft drinks, and the like; fruit juices originating in fruits or vegetables, fruit juices including squeezed juices or the like, fruit juices containing fruit particles, fruit beverages, fruit juice beverages, beverages containing fruit juices, beverages with fruit flavorings, vegetable juices, juices containing vegetables, and mixed juices containing fruits and vegetables; sport drinks, energy drinks, near water and the like drinks (e.g., water with natural or synthetic flavorants); tea type or favorite type beverages such as coffee, cocoa, black tea, green tea, oolong tea and the like; beverages containing milk components such as milk beverages, coffee containing milk components, cafe au lait, milk tea, fruit milk beverages, drinkable yogurt, lactic acid bacteria beverages or the like; and dairy products.

Generally, the amount of sweetener present in a sweetened composition varies widely depending on the particular type of sweetened composition and its desired sweetness. Those of ordinary skill in the art can readily discern the appropriate amount of sweetener to put in the sweetened composition.

The steviol glycoside of the invention can be used in dry or liquid forms. It can be added before or after heat treatment of food products. The amount of the sweetener depends on the purpose of usage. It can be added alone or in the combination with other compounds.

During the manufacturing of foodstuffs, drinks, pharmaceuticals, cosmetics, table top products, chewing gum the conventional methods such as mixing, kneading, dissolution, pickling, permeation, percolation, sprinkling, atomizing, infusing and other methods can be used.

Thus, compositions of the present invention can be made by any method known to those skilled in the art that provide homogenous even or homogeneous mixtures of the ingredients. These methods include dry blending, spray drying, agglomeration, wet granulation, compaction, co-crystallization and the like.

In solid form a steviol glycoside of the invention of the present invention can be provided to consumers in any form suitable for delivery into the comestible to be sweetened, including sachets, packets, bulk bags or boxes, cubes, tablets, mists, or dissolvable strips. The composition can be delivered as a unit dose or in bulk form.

For liquid sweetener systems and compositions convenient ranges of fluid, semi-fluid, paste and cream forms, appropriate packing using appropriate packing material in any shape or form shall be invented which is convenient to carry or dispense or store or transport any combination containing any of the above sweetener products or combination of product produced above.

The composition may include various bulking agents, functional ingredients, colorants, flavors.

Standard genetic techniques, such as overexpression of enzymes in the host cells, genetic modification of host cells, or hybridisation techniques, are known methods in the art, such as described in Sambrook and Russel (2001) "Molecular Cloning: A Laboratory Manual ($3^{rd}$ edition), Cold Spring Harbor Laboratory, Cold Spring Harbor Laboratory Press, or F. Ausubel et al, eds., "Current protocols in molecular biology", Green Publishing and Wiley Interscience, New York (1987). Methods for transformation, genetic modification etc of fungal host cells are known from e.g. EP-A-0 635 574, WO 98/46772, WO 99/60102 and WO 00/37671, WO90/14423, EP-A-0481008, EP-A-0635 574 and U.S. Pat. No. 6,265,186.

Embodiments of the Invention

1. A steviol glycoside having the formula of (I)

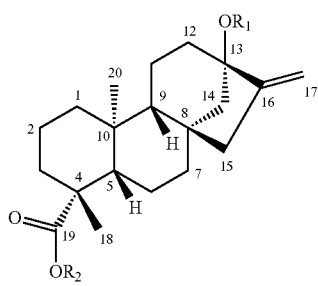

wherein at least 3 sugar moieties are present at positions $R_1$ and at least three sugar moieties are present at position $R_2$ and wherein the steviol glycoside comprises at least seven sugar moieties all of which are linked, directly or indirectly, to the steviol aglycon by β-linkages.

2. A steviol glycoside having the formula of (I)

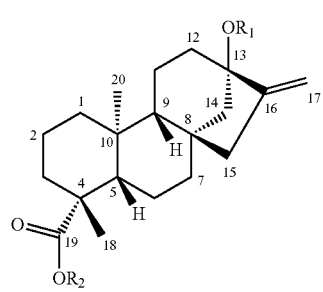

wherein at least 4 sugar moieties are present at positions $R_1$ and at least three sugar moieties are present at position $R_2$.

3. A steviol glycoside having the formula of (I)

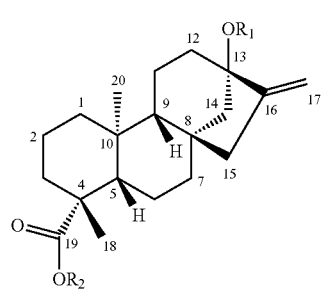

wherein at least 3 sugar moieties are present at positions $R_1$ and at least three sugar moieties are present at position $R_2$, wherein the steviol glycoside comprises at least seven sugar moieties and wherein at least one of the sugars present at position $R_1$ is linked to the steviol aglycon or to a sugar molecule by a α-linkage.

4. A steviol glycoside having the formula of (I)

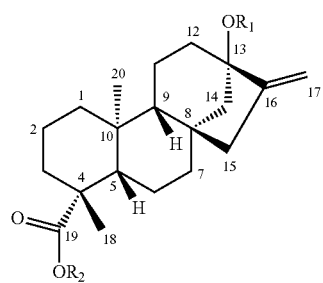

wherein at least 3 sugar moieties are present at positions $R_1$ and at least four sugar moieties are present at position $R_2$, wherein at least four of the sugar moieties present at position $R_2$ are glucose moieties.

5. A steviol glycoside having the formula (II)
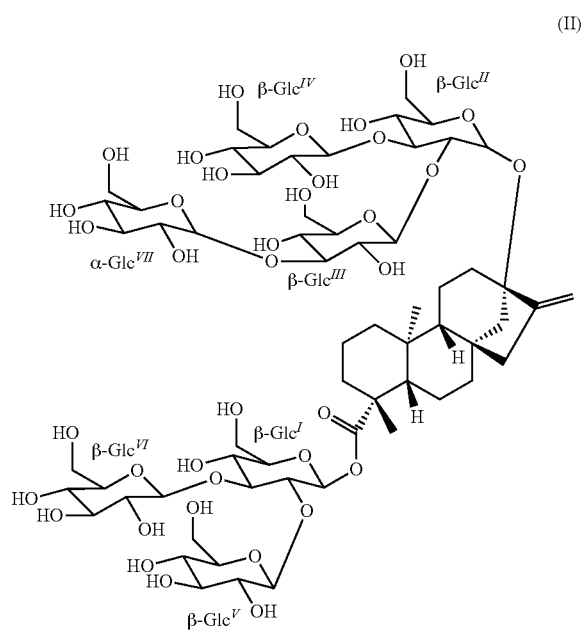
6. A steviol glycoside having the formula (III)
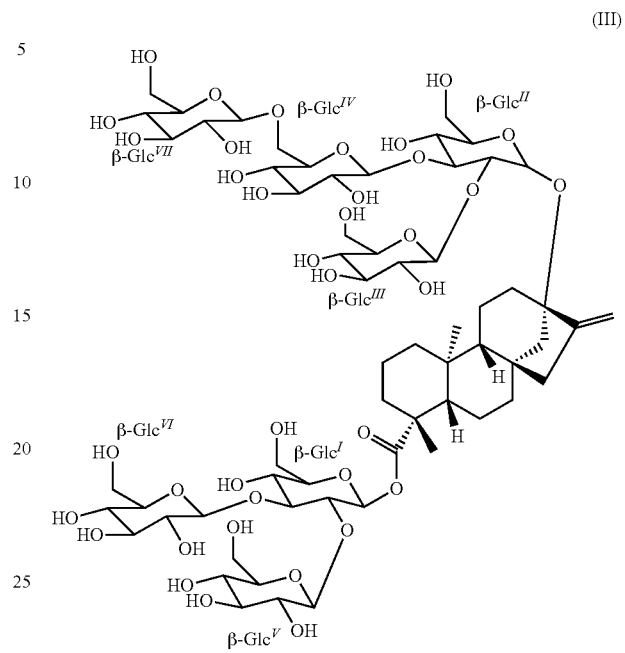
7. A steviol glycoside having the formula (IV)
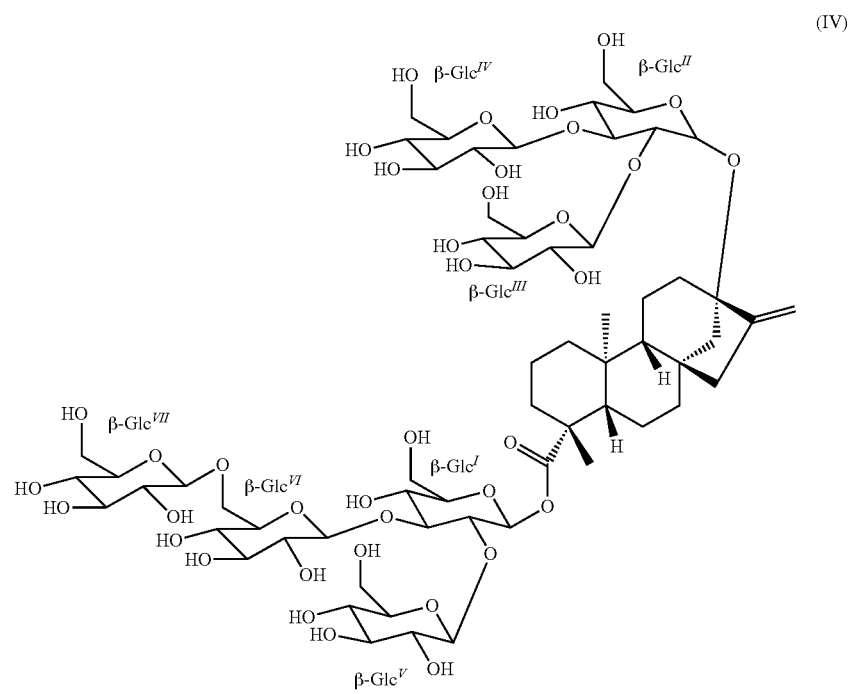

8. A steviol glycoside according to any one of the preceding embodiments which is fermentatively produced.
9. A fermentatively produced steviol glycoside having the formula of (I)

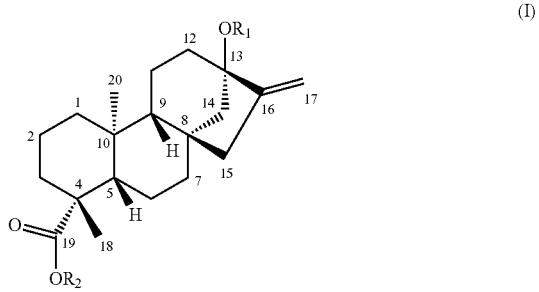

wherein at least 3 sugar moieties are present at positions $R_1$ and at least three sugar moieties are present at position $R_2$ and wherein the steviol glycoside comprises at least seven sugar moieties.
10. A steviol glycoside according to embodiment 9 having a structure according to any one of embodiments 1 to 7.
11. A method for the production of a steviol glycoside according to any one of the preceding embodiments, which method comprises:
providing a recombinant yeast cell comprising recombinant nucleic acid sequences encoding polypeptides comprising the amino acid sequences encoded by: SEQ ID NO: 61, SEQ ID NO: 65, SEQ ID NO: 23, SEQ ID NO: 33, SEQ ID NO: 59, SEQ ID NO: 71, SEQ ID NO: 87, SEQ ID NO: 73 and SEQ ID NO: 75;
fermenting the recombinant yeast cell in a suitable fermentation medium; and, optionally,
recovering a steviol glycoside according to any one of the preceding embodiments.
12. A composition comprising a steviol glycoside according to any one of embodiments 1 to 11 and one or more different steviol glycosides.
13. A foodstuff, feed or beverage which comprises a steviol glycoside according to any one of embodiments 1 to 10 or a composition according to embodiment 12.
14. Use of a steviol glycoside according to any one of embodiments 1 to 10 or a composition according to embodiment 12 in a sweetener composition or flavor composition.
15. Use of a steviol glycoside according to any one of embodiment 1 to 10 or a composition according to embodiment 12 in a foodstuff, feed or beverage.

A reference herein to a patent document or other matter which is given as prior art is not to be taken as an admission that that document or matter was known or that the information it contains was part of the common general knowledge as at the priority date of any of the claims.

The disclosure of each reference set forth herein is incorporated herein by reference in its entirety.

The present invention is further illustrated by the following Examples:

EXAMPLES

Example 1

Construction of STV016

*S. cerevisiae* Strain STV016 was constructed for the fermentative production of steviol glycosides.
1.1 Over-Expression of ERG20, BTS1 and tHMG in *S. cerevisiae*

For over-expression of ERG20, BTS1 tHMG1, expression cassettes were designed to be integrated in one locus using technology described in WO2013/076280. To amplify the 5' and 3' integration flanks for the integration locus, suitable primers and genomic DNA from a CEN.PK yeast strain (van Dijken et al. Enzyme and Microbial Technology 26 (2000) 706-714) was used. The different genes were ordered as cassettes (containing homologous sequence, promoter, gene, terminator, homologous sequence) at DNA2.0. The genes in these cassettes were flanked by constitutive promoters and terminators. See Table 1. Plasmid DNA from DNA2.0 containing the ERG20, tHMG1 and BTS1 cassettes were dissolved to a concentration of 100 ng/μl. In a 50 μl PCR mix 20 ng template was used together with 20 pmol of the primers. The material was dissolved to a concentration of 0.5 μg/μl.

TABLE 1

Composition of the over-expression constructs

| Promoter | ORF | Terminator |
| --- | --- | --- |
| Eno2 (SEQ ID NO: 201) | Erg20 (SEQ ID NO: 81) | Adh1 (SEQ ID NO: 212) |
| Fba1 (SEQ ID NO: 202) | tHMG1 (SEQ ID NO: 79) | Adh2 (SEQ ID NO: 213) |
| Tef1 (SEQ ID NO: 203) | Bts1 (SEQ ID NO: 83) | Gmp1 (SEQ ID NO: 214) |

For amplification of the selection marker, the pUG7-EcoRV construct (FIG. 1) and suitable primers were used. The KanMX fragment was purified from gel using the Zymoclean Gel DNA Recovery kit (ZymoResearch). Yeast strain Cen.PK113-3C was transformed with the fragments listed in Table 2.

TABLE 2

DNA fragments used for transformation of ERG20, tHMG1 and BTS1
Fragment

5'YPRcTau3
ERG20 cassette
tHMG1 cassette
KanMX cassatte
BTS1 cassette
3'YPRcTau3

Figure 2:
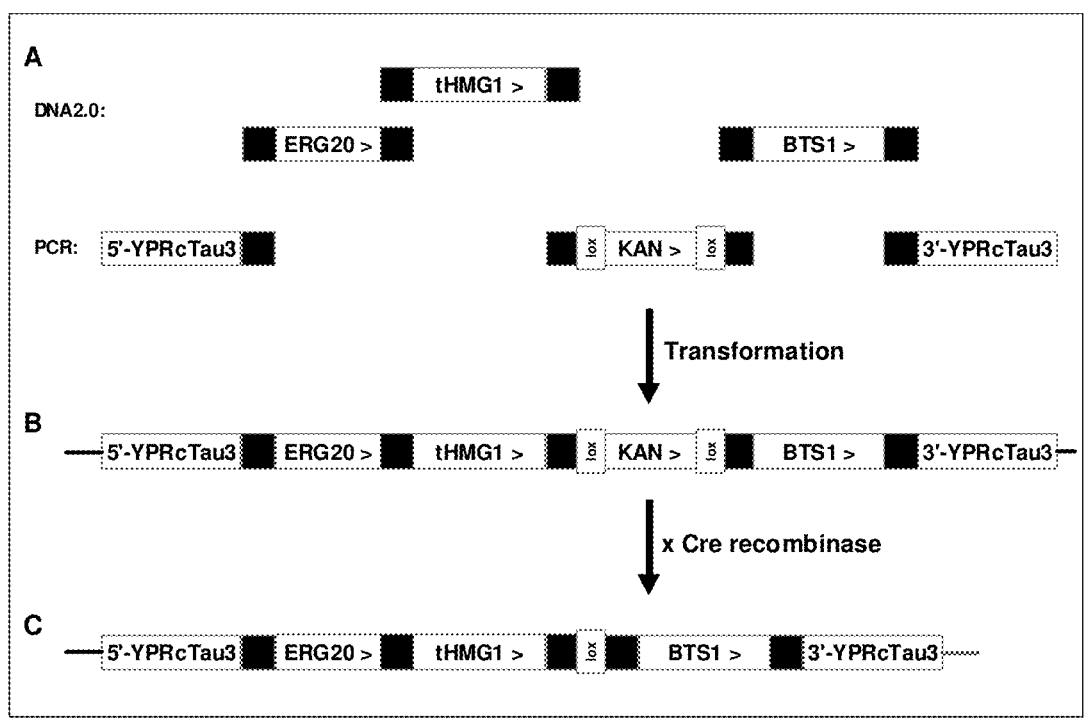
FIG. 2 sets out a schematic representation of the method by which the ERG20, tHMG1 and BTS1 over-expression cassettes are designed (A) and integrated (B) into the yeast genome. (C) shows the final situation after removal of the KANMX marker by the Cre recombinase.

After transformation and recovery for 2.5 hours in YEPhD (yeast extract phytone peptone glucose; BBL Phytone Peptone from BD) at 30° C. the cells were plated on YEPhD agar with 200 μg/ml G418 (Sigma). The plates were incubated at 30° C. for 4 days. Correct integration was established with diagnostic PCR and sequencing. Overexpression was confirmed with LC/MS on the proteins. The schematic of the assembly of ERG20, tHMG1 and BTS1 is illustrated in FIG. 2. This strain was named STV002.

Expression of the CRE-recombinase in this strain led to out-recombination of the KanMX marker. Correct out-recombination, and presence of ERG20, tHMG and BTS1 was established with diagnostic PCR.

1.2 Knock-Down of Erg9

For reducing the expression of Erg9, an Erg9 knock down construct was designed and used that contains a modified 3' end, that continues into the TRP1 promoter driving TRP1 expression.

Figure 3:
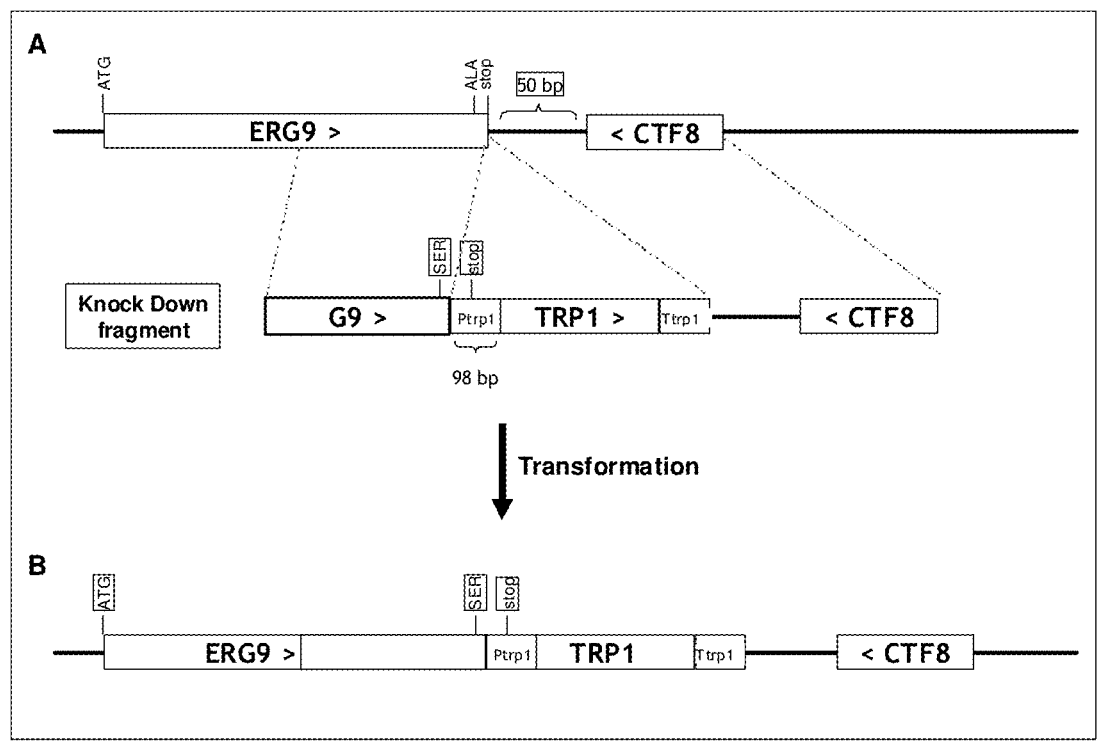
FIG. 3 sets out a schematic representation of the ERG9 knock down construct. This consists of a 500 bp long 3' part of ERG9, 98 bp of the TRP1 promoter, the TRP1 open reading frame and terminator, followed by a 400 bp long downstream sequence of ERG9. Due to introduction of a XbaI site at the end of the ERG9 open reading frame the last amino acid changes into Ser and the stop codon into Arg. A new stop codon is located in the TPR1 promoter, resulting in an extension of 18 amino acids.

The construct containing the Erg9-KD fragment was transformed to *E. coli* TOP10 cells. Transformants were grown in 2PY(2 times Phytone peptone Yeast extract), sAMP medium. Plasmid DNA was isolated with the QIAprep Spin Miniprep kit (Qiagen) and digested with SalI-HF (New England Biolabs). To concentrate, the DNA was precipitated with ethanol. The fragment was transformed to *S. cerevisiae*, and colonies were plated on mineral medium (Verduyn et al, 1992. Yeast 8:501-517) agar plates without tryptophan. Correct integration of the Erg9-KD construct was confirmed with diagnostic PCR and sequencing. The schematic of performed transformation of the Erg9-KD construct is illustrated in FIG. 3. The strain was named STV003.

1.3 Over-Expression of UGT2_1a

For over-expression of UGT2_1a, technology was used as described in co-pending patent application nos. WO2013/076280 and WO2013/144257. The UGT2a was ordered as a cassette (containing homologous sequence, promoter, gene, terminator, homologous sequence) at DNA2.0. For details, see Table 3. To obtain the fragments containing the marker and Cre-recombinase, technology was used as described in co-pending patent application no. WO2013/135728. The NAT marker, conferring resistance to nourseothricin was used for selection.

TABLE 3

Composition of the over-expression construct

| Promoter | ORF | Terminator |
|---|---|---|
| Pgk1 (SEQ ID NO: 204) | UGT2_1a (SEQ ID NO: 87) | Adh2 (SEQ ID NO: 213) |

Suitable primers were used for amplification. To amplify the 5' and 3' integration flanks for the integration locus, suitable primers and genomic DNA from a CEN.PK yeast strain was used.

*S. cerevisiae* yeast strain STV003 was transformed with the fragments listed in Table 4, and the transformation mix was plated on YEPhD agar plates containing 50 µg/ml nourseothricin (Lexy NTC from Jena Bioscience).

TABLE 4

DNA fragments used for transformation of UGT2a
Fragment

5'Chr09.01
UGT2a cassette
NAT-CR
RE
3'Chr09.01

Figure 4:
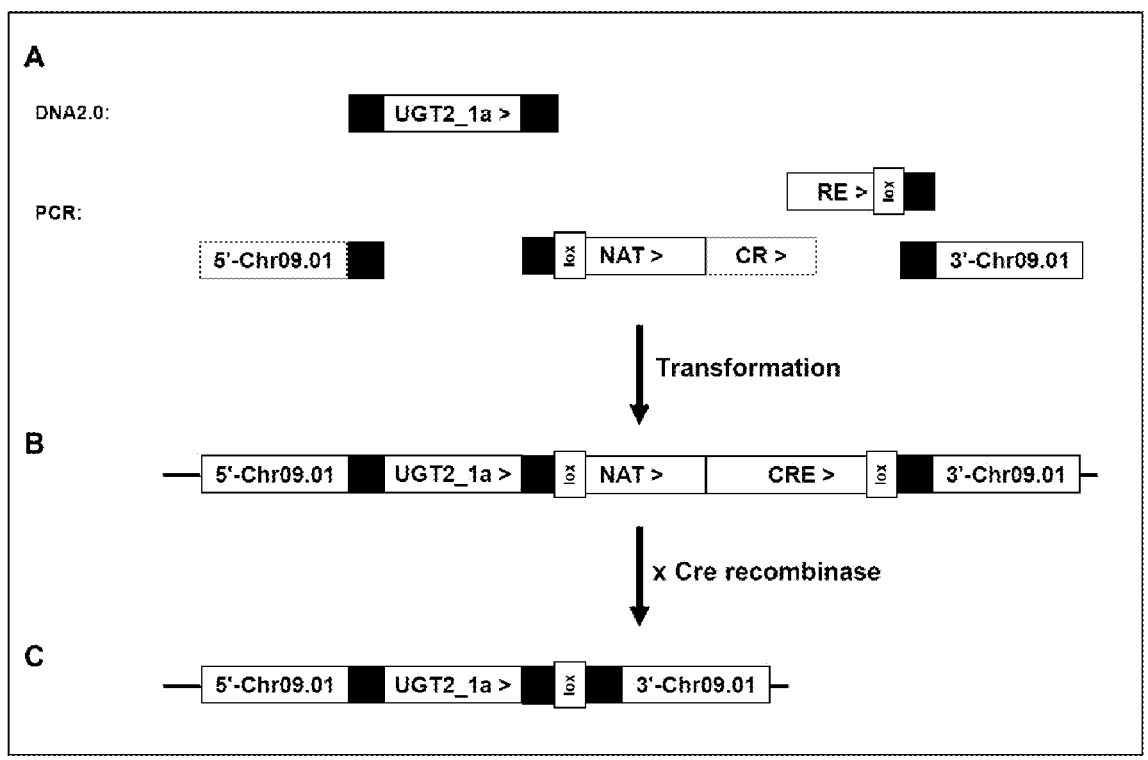
FIG. 4 sets out a schematic representation of how UGT2 is integrated into the genome. A. different fragments used in transformation; B. situation after integration; C. situation after expression of Cre recombinase).

Expression of the CRE recombinase is activated by the presence of galactose. To induce the expression of the CRE recombinase, transformants were restreaked on YEPh Galactose medium. This resulted in out-recombination of the marker(s) located between lox sites. Correct integration of the UGT2a and out-recombination of the NAT marker was confirmed with diagnostic PCR. The resulting strain was named STV004. The schematic of the performed transformation of the UGT2a construct is illustrated in FIG. 4.

1.4 Over-Expression of Production Pathway to RebA: CPS, KS, KO, KAH, CPR, UGT1, UGT3 and UGT4

All pathway genes leading to the production of RebA were designed to be integrated in one locus in the STV004 strain background. To amplify the 5' and 3' integration flanks for the integration locus (site 3), suitable primers and genomic DNA from a CEN.PK yeast strain was used. The different genes were ordered as cassettes (containing homologous sequence, promoter, gene, terminator, homologous sequence) at DNA2.0 (see Table 5 for overview). The DNA from DNA2.0 was dissolved to 100 ng/µl. This stock solution was further diluted to 5 ng/µl, of which 1 µl was used in a 50 µl-PCR mixture. The reaction contained 25 pmol of each primer. After amplification, DNA was purified with the NucleoSpin 96 PCR Clean-up kit (Macherey-Nagel) or alternatively concentrated using ethanol precipitation.

TABLE 5

Composition of the over-expression constructs
for CPS, KS, KO, KAH, CPR, UGT1, UGT3 and UGT4

| Promoter | ORF | Terminator |
|---|---|---|
| Kl prom 12.pro (SEQ ID NO: 205) | CPS (SEQ ID NO: 61) | Sc Adh2.ter (SEQ ID NO: 213) |
| Sc Pgk1.pro (SEQ ID NO: 204) | KS (SEQ ID NO: 65) | Sc Tal1.ter (SEQ ID NO: 215) |
| Sc Eno2.pro (SEQ ID NO: 201) | KO (SEQ ID NO: 23) | Sc Tpi1.ter (SEQ ID NO: 216) |
| Ag lox_Tef1.pro (SEQ ID NO: 206) | KANMX (SEQ ID NO: 211) | Ag Tef1_lox.ter (SEQ ID NO: 217) |
| Sc Tef1.pro (SEQ ID NO: 203) | KAH (SEQ ID NO: 33) | Sc Gpm1.ter (SEQ ID NO: 214) |
| Kl prom 6.pro (SEQ ID NO: 207) | CPR (SEQ ID NO: 77) | Sc Pdc1.ter (SEQ ID NO: 218) |
| Sc Pma1.pro (SEQ ID NO: 208) | UGT1 (SEQ ID NO: 71) | Sc Tdh1.ter (SEQ ID NO: 219) |
| Sc Vps68.pro (SEQ ID NO: 209) | UGT3 (SEQ ID NO: 73) | Sc Adh1.ter (SEQ ID NO: 212) |
| Sc Oye2.pro (SEQ ID NO: 210) | UGT4 (SEQ ID NO: 75) | Sc Eno1.ter (SEQ ID NO: 220) |

All fragments for the pathway to RebA, the marker and the flanks (see overview in Table 6) were transformed to a S. cerevisiae yeast strain STV004. After overnight recovery in YEPhD at 20° C. the transformation mixes were plated on YEPhD agar containing 200 μg/ml G418. These were incubated 3 days at 30° C.

TABLE 6

DNA fragments used for transformation of CPS, KS, KO, KanMX, KAH, CPR, UGT1, UGT3 and UGT4

| Fragment |
|---|
| 5' INT1 |
| CPS cassette |
| KS cassette |
| KO cassette |
| KanMX cassette |
| KAH cassette |
| CPR cassette |
| UGT1 cassette |
| UGT3 cassette |
| UGT4 cassette |
| 3'INT1 |

Figure 5:
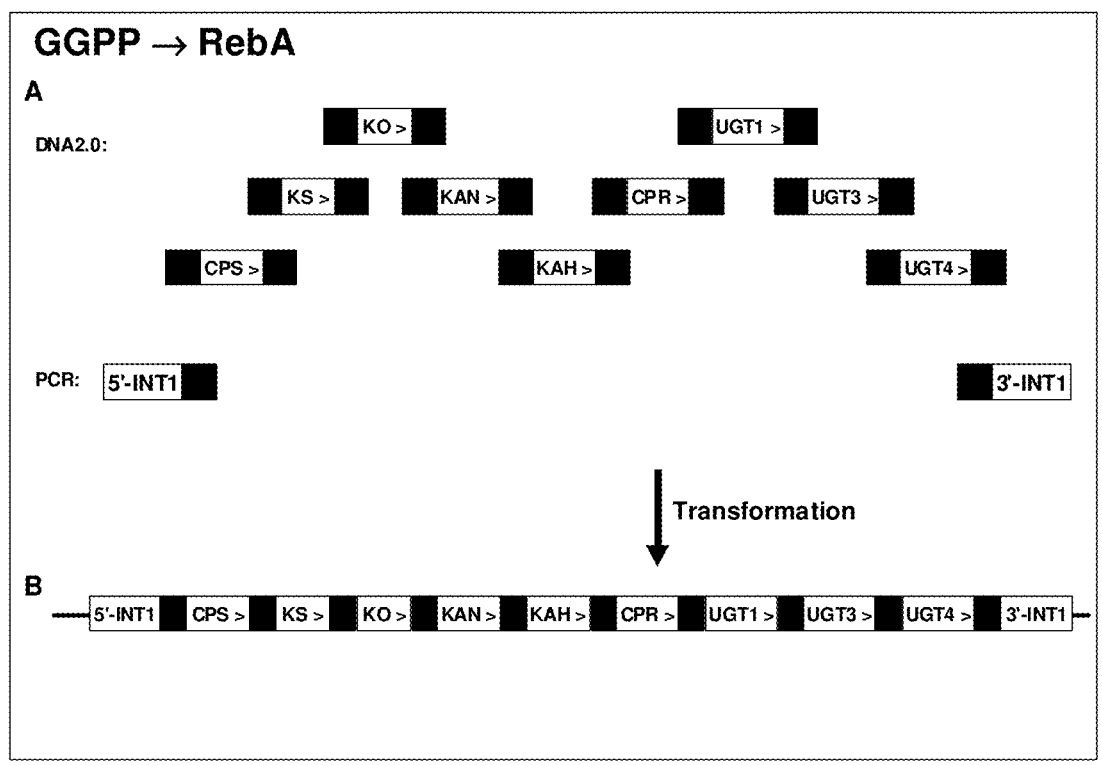
FIG. 5 sets out a schematic representation of how the pathway from GGPP to RebA is integrated into the genome. A. different fragments used in transformation; B. situation after integration.

Correct integration was confirmed with diagnostic PCR and sequence analysis (3500 Genetic Analyzer, Applied Biosystems). The sequence reactions were done with the BigDye Terminator v3.1 Cycle Sequencing kit (Life Technologies). Each reaction (10 μl) contained 50 ng template and 3.2 pmol primer. The products were purified by ethanol/EDTA precipitation, dissolved in 10 μl HiDi formamide and applied onto the apparatus. The strain was named STV016. The schematic of how the pathway from GGPP to RebA is integrated into the genome is illustrated in FIG. 5. Table 7 sets out the strains used in this Example 1.

TABLE 7

Table of strains

| Strain | Background | Genotype |
|---|---|---|
| Cen.PK113-3C | — | MATa URA3 HIS3 LEU2 trp1-289 MAL2-8C SUC2 |
| STV002 | Cen.PK113-3C | MATa URA3 HIS3 LEU2 trp1-289 MAL2-8C SUC2 YPRcTau3::ERG20, tHMG1, KanMX, BTS1 |
| STV003 | STV002 | MATa URA3 HIS3 LEU2 trp1-289 MAL2-8C SUC2 YPRcTau3::ERG20, tHMG1, KanMX, BTS1 ERG9::ERG9-KD TRP1 |
| STV004 | STV003 | MATa URA3 HIS3 LEU2 trp1-289 MAL2-8C SUC2 YPRcTau3::ERG20, tHMG1, BTS1 ERG9::ERG9-KD TRP1 Chr09.01::UGT91D2 |
| STV016 | STV004 | MATa URA3 HIS3 LEU2 trp1-289 MAL2-8C SUC2 YPRcTau3::ERG20, tHMG1, BTS1 ERG9::ERG9-KD TRP1 Chr09.01::UGT2_1a INT1::CPS, KS, KO, KanMX, KAH, CPR, UGT1, UGT3, UGT4 |

1.5 Fermentation of STV016

The S. cerevisiae strain STV016 constructed as described above, were cultivated in shake-flasks (2 l with 200 ml medium) for 32 hours at 30° C. and 220 rpm. The medium was based on Verduyn et al. (Verduyn C, Postma E, Scheffers W A, Van Dijken J P. Yeast, 1992 July; 8(7):501-517), with modifications in the carbon and nitrogen sources, as described in Table 8.

TABLE 8

Preculture medium composition

| Raw material | Formula | Concentration (g/kg) |
|---|---|---|
| Galactose | $C_6H_{12}O_6$ | 20.0 |
| Urea | $(NH_2)_2CO$ | 2.3 |

TABLE 8-continued

Preculture medium composition

| Potassium dihydrogen phosphate | $KH_2PO_4$ | 3.0 |
|---|---|---|
| Magnesium sulphate | $MgSO_4 \cdot 7H_2O$ | 0.5 |
| Trace element solution | | 1 |
| Vitamin solution | | 1 |

| Component | Formula | Concentration (g/kg) |
|---|---|---|
| [a]Trace elements solution | | |
| EDTA | $C_{10}H_{14}N_2Na_2O_8 \cdot 2H_2O$ | 15.00 |
| Zincsulphate·7H2O | $ZnSO_4 \cdot 7H_2O$ | 4.50 |
| Manganesechloride·2H2O | $MnCl_2 \cdot 2H_2O$ | 0.84 |
| Cobalt (II) chloride·6H2O | $CoCl_2 \cdot 6H_2O$ | 0.30 |
| Cupper (II) sulphate·5H2O | $CuSO_4 \cdot 5H_2O$ | 0.30 |
| Sodium molybdenum·2H2O | $Na_2MoO_4 \cdot 2H_2O$ | 0.40 |
| Calciumchloride·2H2O | $CaCl_2 \cdot 2H_2O$ | 4.50 |
| Ironsulphate·7H2O | $FeSO_4 \cdot 7H_2O$ | 3.00 |
| Boric acid | $H_3BO_3$ | 1.00 |
| Potassium iodide | KI | 0.10 |
| [b]Vitamin solution | | |
| Biotin (D-) | $C_{10}H_{16}N_2O_3S$ | 0.05 |
| Ca D(+) panthothenate | $C_{18}H_{32}CaN_2O_{10}$ | 1.00 |
| Nicotinic acid | $C_6H_5NO_2$ | 1.00 |
| Myo-inositol | $C_6H_{12}O_6$ | 25.00 |
| Thiamine chloride hydrochloride | $C_{12}H_{18}Cl_2N_4OS \cdot xH_2O$ | 1.00 |
| Pyridoxol hydrochloride | $C_8H_{12}ClNO_3$ | 1.00 |
| p-aminobenzoic acid | $C_7H_7NO_2$ | 0.20 |

Subsequently, 200 ml of the content of the shake-flask was transferred into a fermenter (starting volume 5 L), which contained the medium as set out in Table 9.

TABLE 9

Composition fermentation medium

| Raw material | | Final Concentration (g/kg) |
|---|---|---|
| Glucose·1aq | $C_6H_{12}O_6 \cdot 1H_2O$ | 4.4 |
| Ammonium sulphate | $(NH_4)_2SO_4$ | 1 |
| Potassium dihydrogen phosphate | $KH_2PO_4$ | 10 |
| Magnesium sulphate | $MgSO_4 \cdot 7H_2O$ | 5 |
| Trace element solution | — | 8 |
| Vitamin solution | — | 8 |

The pH was controlled at 5.0 by addition of ammonia (25 wt %). Temperature was controlled at 27° C. $pO_2$ was controlled at 40% by adjusting the stirrer speed. Glucose concentration was kept limited by controlled feed to the fermenter as set out in Table 10.

TABLE 10

Composition of the fermentation feed medium

| Raw material | Formula | Final Concentration (g/kg) |
|---|---|---|
| Glucose•1aq | $C_6H_{12}O_6 \cdot 1H_2O$ | 550 |
| Potassium dihydrogen phosphate | $KH_2PO_4$ | 15.1 |
| Magnesium sulphate heptahydrate | $MgSO_4 \cdot 7H_2O$ | 7.5 |
| Verduyn trace elements solution | | 12 |
| Verduyn vitamin solution | | 12 |

Example 2

Observation of 7.1, 7.2 and 7.3 Using LC-MS

Steviol glycosides containing 7 glucose molecules (further referred to as 7.1, 7.2 and 7.3) were observed with the LC-MS system described below in the mother liquid after crystallization of rebaudioside A in a water/ethanol mixture (strain STV016). Prior to purification the sample was concentrated by evaporation.

7.1, 7.2 and 7.3 were analyzed on an Acquity UPLC (Waters) coupled to a XEVO-TQ Mass Spectrometer (Waters) equipped with an electrospray ionization source operated in the negative-ion mode in MRM mode at the deprotonated molecules for all steviol glycosides studied, among these m/z 1451.5, representing the deprotonated molecule of a steviol glycoside containing 7 glucose molecules.

The chromatographic separation was achieved with a 2.1×100 mm 1.8 µm particle size, Acquity UPLC® HSS T3 column, using a gradient elution with (A) 50 mM ammonium acetate in LC-MS grade water, and B) LC-MS grade acetonitrile as mobile phases. The 4 min gradient started from 30% B linearly increasing to 35% B in 0.5 minutes and kept at 35% B for 0.8 minutes, then linearly increased to 95% B in 0.7 minutes and kept there for 0.5 minutes, then re-equilibrating with 30% B for 1.5 min. The flow rate was kept at 0.6 ml/min, using an injection volume of 5 µl and the column temperature was set to 50° C. The individual compounds, 7.1, 7.2 and 7.3, observed for m/z 1451.5 elute at retention times 0.59, 0.71 and 0.74 minutes.

For the analysis of elemental composition of 7.1, 7.2 and 7.3 HRMS (High Resolution Mass Spectrometry) analysis was performed with an LTQ-Orbitrap Fourier Transform Mass Spectrometer (Thermo Electron) equipped with an electrospray ionization source operated in the negative-ion mode, scanning from m/z 300-2000.

The chromatographic separation was achieved with an Acella LC system (Thermo Fisher) with the same column and gradient system as described above.

Figure 6A:
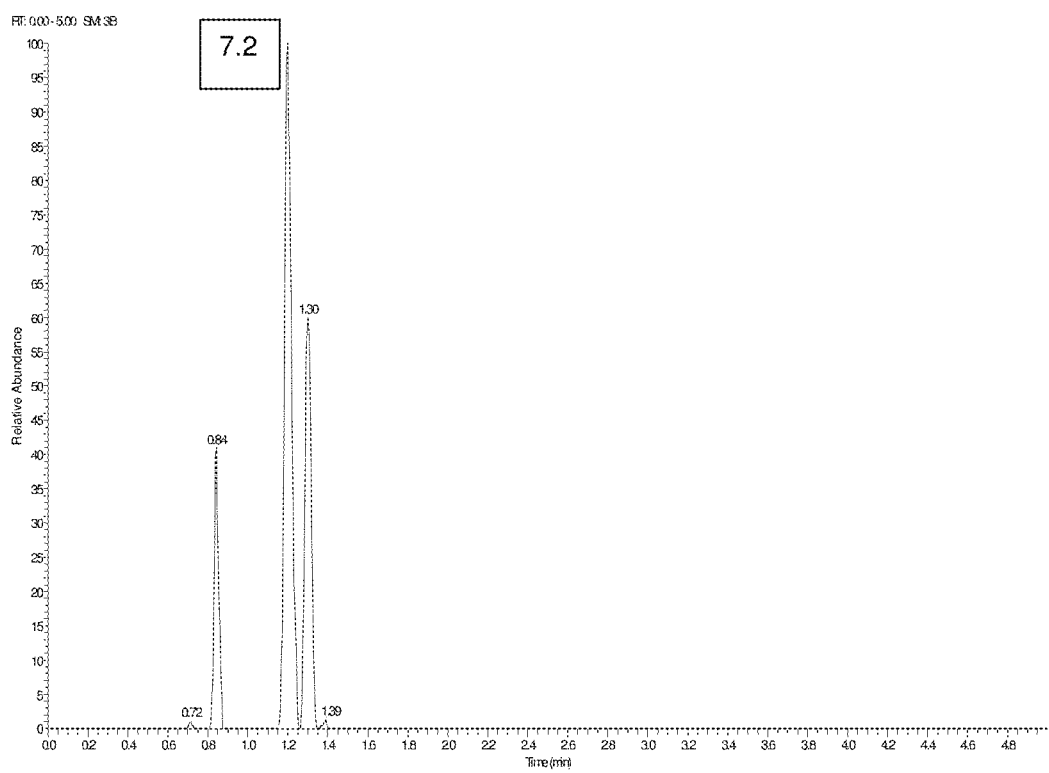
FIG. 6a shows an extracted ion chromatogram of m/z 1451.5820 of the mixture of the steviol glycosides containing 7 glucoses (7.1, 7.2 and 7.3) in the ethanol extract (starting material for purification), using High Resolution Mass Spectrometry.
Figure 7:
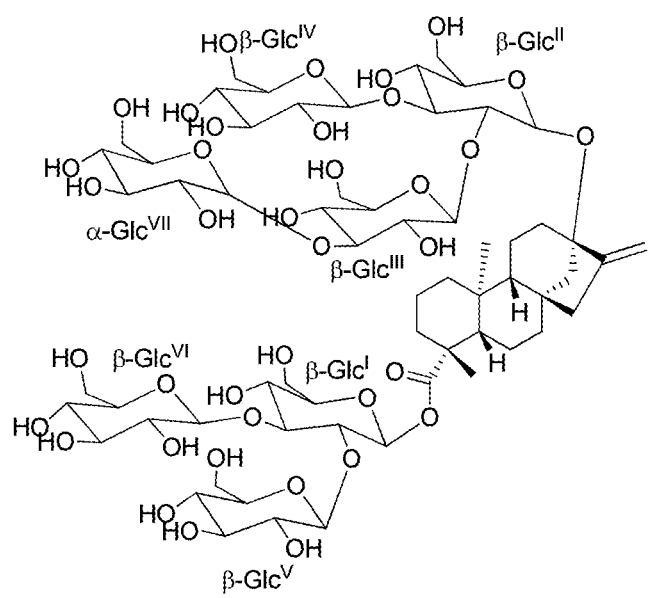
FIG. 7 shows the structure of Rebaudioside 7.1.

Using this chromatographic system the individual compounds elute at retention times 0.84, 1.20 and 1.30 minutes, respectively as shown in FIG. 6a, and 7.1, 7.2 and 7.3 were characterized at respectively m/z 1451.5786, 1451.5793, and 1451.5793, which is in good agreement with the theoretical m/z value of 1451.5820 (respectively−1.8 and −2.3 ppm). The corresponding chemical formula of these components is $C_{62}H_{100}O_{38}$ for the uncharged species.

Example 3

Purification of 7.1, 7.2. and 7.3 Using Preparative LC-UV

Purification of 7.1, 7.2 and 7.3 was performed from the ethanol extract of *Saccharomyces* broth (strain STV016) containing minimal amount of the compounds of interest. Preparative separation was performed using Reversed Phase chromatography (Waters Atlantis T3, 30*150 mm, 5 um), gradient elution with LC-MS grade water and acetonitrile as eluent. A flow-rate of 40 ml/min and an injection volume of 300 ul was used.

Approximately 100 injections were performed and the compounds of interest were triggered by UV detection at 210 nm. All fractions of 7.1, 7.2 and 7.3 were pooled and freeze dried, before LC-MS and NMR analysis.

LC-MS of 7.1, 7.2 and 7.3 for Mass Confirmation and Purity Determination After Preparative Purification, Using LC-MS.

Figure 6B:
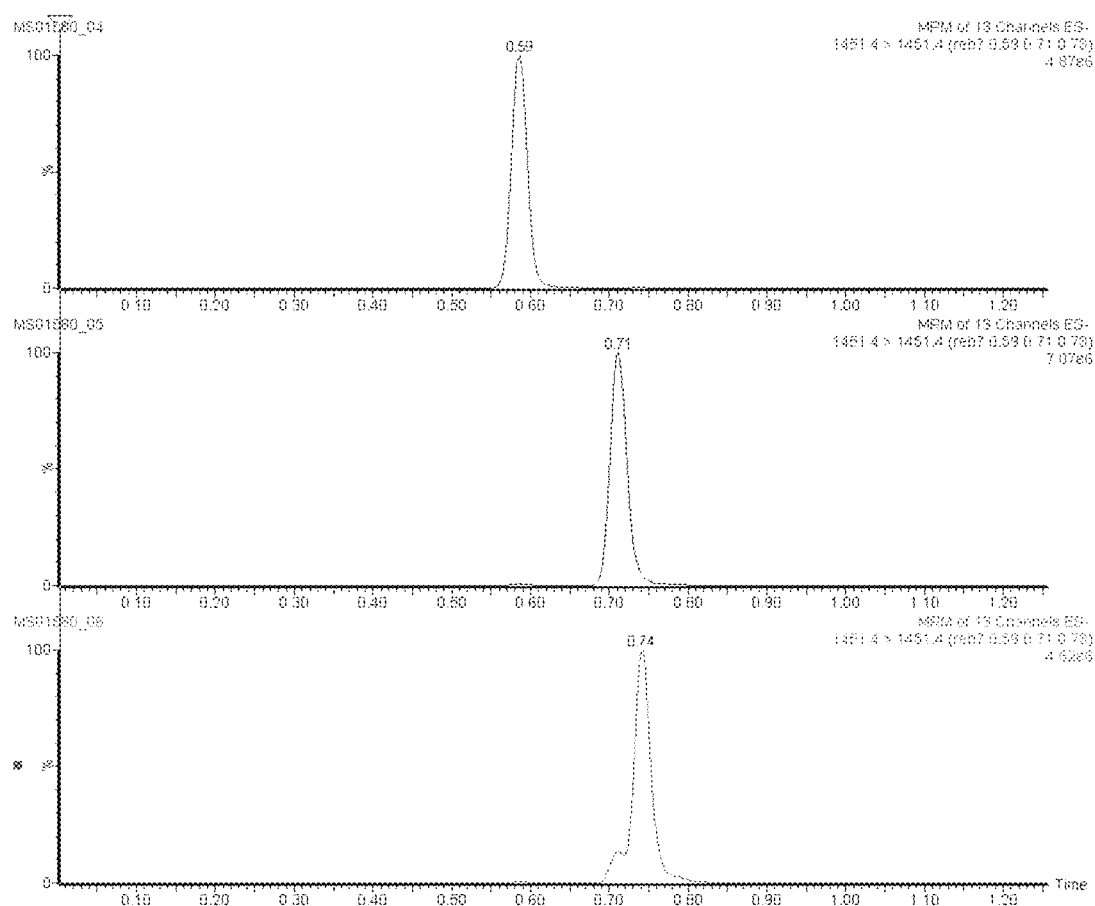
FIG. 6b: extracted ion chromatogram of m/z 1451.5 of the purified steviol glycosides containing 7 glucoses (7.1, 7.2 and 7.3), using LC-MS.

The purity of 7.1, 7.2 and 7.3 was analyzed on an Acquity UPLC (Waters) coupled to a XEVO-TQ Mass Spectrometer (Waters) equipped with an electrospray ionization source operated in the negative-ion mode in MRM mode at the deprotonated molecules for all steviol glycosides studied, among these m/z 1451.5, representing the deprotonated molecule of a steviol glycoside containing 7 glucose molecules. 7.1 eluting at retention time 0.59 minutes could be estimated to be over 80% pure, whereas 7.2 and 7.3, eluting at retention times 0.71 and 0.74 minutes, could be estimated to be over 90% pure and 7.3 still contains about 5% of 7.2, shown in FIG. 6b.

Using HRMS (High Resolution Mass Spectrometry) analysis was performed with an LTQ-Orbitrap Fourier Transform Mass Spectrometer (Thermo Electron) equipped with an electrospray ionization source operated in the negative-ion mode the elemental composition of the individual compound was checked and found to be in agreement with the theoretical mass corresponding to the chemical formula of $C_{62}H_{100}O_{38}$ for the uncharged species.

Example 4

Analysis of Rebaudioside 7.1

1.1 mg of fraction 7.1 obtained as described in Example 3 was dissolved in 1.3 mL of $CDCl_3$/pyridine-d5 1/3 (w/w) and 2 drops of DCOOD.

A series of COSY and TOCSY 2D NMR spectra with small increments of the mixing time afforded the assignment of almost all protons of each spin system (of the seven sugar units) for all three Rebaudiosides as well as the ent-kaurane diterpenoid core. The HSQC experiment allowed for the assigment of corresponding C—H couples.

The anomeric H of $glc^I$ and $glc^{II}$ were identified based on their long range correlation in HMBC to the protons of the ent-kaurane diterpenoid core.

Figure 10:
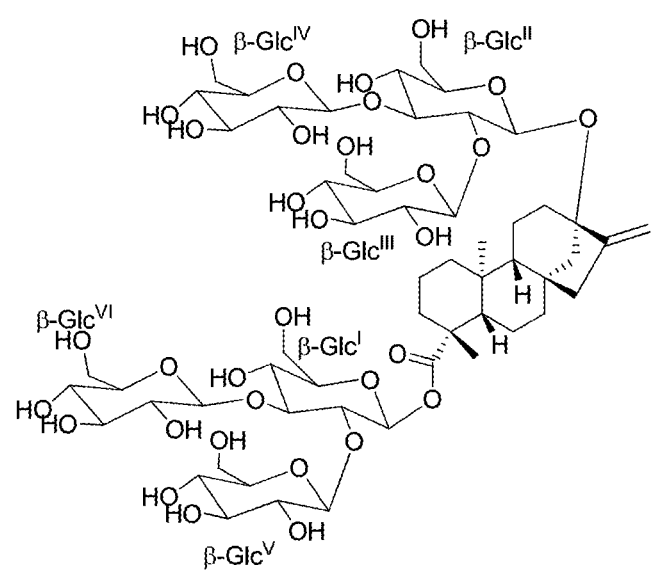
FIG. 10 shows the structure of Rebaudioside M.

The long range correlation of $H2^I$-$H1^V$ and $H3^I$-$H1^{VI}$ and $H2^{II}$-$H1^{III}$ and $H3^{II}$-$H1^{IIII}$ observed in corresponding ROESY spectra allowed the assigment of the substitution sites of $glc^I$ and $glc^{II}$. The assigment was also corroborated by the long range correlation in HMBC experiment of the anomeric protons of $glc^{III}$ up to $glc^{VI}$ with the $^{13}C$ atoms of $glc^I$ and $glc^{II}$, namely $H1^{III}$-$C2^{II}$, $H1^{IIII}$-$C3^{II}$, $H1^V$-$C2^I$ and $H1^{IV}$-$C3^I$. The position of sugars $glc^{III}$, $glc^{IV}$, $glc^V$ and $glc^{VI}$ is identical as in the structure of Rebaudioside M (FIG. 10).

The down field shift of the anomeric $H1^{VII}$ (5.86 ppm vs. 4.5-4.6 ppm) and small coupling constant (3.8 Hz vs. 7.8 Hz) indicates that the seventh sugar residue has the a configuration.

The position of the $7^{th}$ sugar in Rebaudioside 7.1 could be identified from the long range HMBC coupling of $H1^{VII}$ and $C3^{III}$ long range proton coupling of $H1^{VII}$-$H3^{III}$ ROESY experiment and the low field shift of the $C3^{III}$ (83.8 ppm as compared to unsubstituted C3 atoms around 78-79 ppm). The structure of rebaudioside 7.1 is depicted in FIG. 7. All $^1H$ and $^{13}C$ NMR chemical shifts for Rebaudioside 7.1 are listed in Table 11. For the sake of comparison also the data of Rebaudioside M are included.

TABLE 11

$^1$H and $^{13}$C NMR chemical shifts of Rebaudioside 7.1 in CDCl$_3$/pyridine 1/3 and 3 drops of DCOOD recorded at 320K and Rebaudioside M in CDCl$_3$/pyridine 1/1 and 3 drops of DCOOD recorded at 300K, $\delta_{TMS} = 0$

| Position | Rebaudioside M $^1$H | $^{13}$C | Rebaudioside 7.1 $^1$H | $^{13}$C |
|---|---|---|---|---|
| 1 | 0.77 (dt, 13.5& 4 Hz)&1.76 (m) | 39 | 0.74 (dt, 13.6& 4.2 Hz)&1.72 (m) | 41.6 |
| 2 | 1.35&2.12 (m) | 19.1 | 1.69 & 2.06 (m) | 17.4 |
| 3 | 1.0 (dt, 13.2&4.7)&2.14 (m) | 38.2 | 0.99 (m) &2.33 (d, 13 Hz) | 38.2 |
| 4 | — | 43.8 | — | 43.8 |
| 5 | 1.02 (t, 13 Hz) | 57 | 1.01 (d, 14.1 Hz) | 58.6 |
| 6 | 2.03 (m)&2.17 (m) | 23.2 | 1.93 & 2.11 (m) | 23.9 |
| 7 | 1.37&1.66 (m) | 42.2 | 1.38 & 1.53 (m) | 43.5 |
| 8 | — | 40.6 | — | 42.5 |
| 9 | 0.89 (d, 8.1 Hz) | 54.1 | 0.88 (d, 7.7 Hz) | 55.3 |
| 10 | — | 40 | — | 40.9 |
| 11 | 1.57 & 1.68(m) | 19.8 | 1.56 & 1.64 (m) | 21.3 |
| 12 | 1.66&2.43 (m) | 37.9 | 1.66 & 2.28 (m) | 39.5 |
| 13 | — | 87.3 | — | 88.6 |
| 14 | 1.76 (m) & 2.49(d, 10.9 Hz) | 42.7 | 1.72 & 2.40 (m) | 44.8 |
| 15 | 1.83&1.99 (d, 17.3 Hz) | 45.9 | 1.89 & 1.99 (d, 17 Hz) | 48.1 |
| 16 | — | 152.2 | — | 154 |
| 17 | 4.78&5.42 (s) | 104.6 | 4.85 & 5.45 (s) | 105.9 |
| 18 | 1.21 (s) | 27 | 1.22 (s) | 29.8 |
| 19 | — | 176.4 | — | 176.1 |
| 20 | 1.15 (s) | 16.1 | 1.08 (s) | 15.9 |
| $1^I$ | 5.98 (d, 8.3 Hz) | 94.6 | 5.99 (d, 8.2 Hz) | 94.9 |
| $2^I$ | 4.22 (t, 8.6 Hz) | 76.1 | 4.28 (t) | 77.5 |
| $3^I$ | 4.88 (t, 8.7 Hz) | 87.9 | 4.52 (t, 9.2 Hz) | 89.9 |
| $4^I$ | 3.88 (m) | 69.6 | 4.00 (m) | 71.1 |
| $5^I$ | 3.86 (m) | 77.5 | 4.11 (m) | 78.8 |
| $6^I$ | 4.06 &3.92 (m) | 61.4 | 5.06 & 3.98 (m) | 62.7 |
| $1^{II}$ | 5.15 (d, 7.7 Hz) | 95.3 | 5.07 (d, 7.8 Hz) | 97.3 |
| $2^{II}$ | 3.81 (m) | 80.8 | 3.87 (m) | 82.4 |
| $3^{II}$ | 4.67 (t, 9 Hz) | 87 | 4.58 (t, 9.1 Hz) | 88 |
| $4^{II}$ | 3.68 (m) | 69.9 | 3.76 (m) | 71 |
| $5^{II}$ | 3.74 (m) | 77.1 | 3.63 (m) | 78.4 |
| $6^{II}$ | 4.06&3.92 (m) | 62.3 | 4.09 & 3.95 (m) | 63.6 |
| $1^{III}$ | 5.13 (d, 7.6 Hz) | 104 | 5.22 (d, 8.2 Hz) | 105.24 |
| $2^{III}$ | 3.81 (m) | 74.9 | 3.72 (m) | 75.1 |
| $3^{III}$ | 3.81 (m) | 77.8 | 4.04 (m) | 83.8 |
| $4^{III}$ | 3.60 (m) | 72.8 | 3.87 (m) | 74.1 |
| $5^{III}$ | 3.45 (m) | 76.3 | 3.42 (m) | 77.9 |
| $6^{III}$ | 4.2&3.91 (m) | 63.6 | 4.12 & 3.92 (m) | 64.4 |
| $1^{IV}$ | 5.147 (d, 8.1 Hz) | 103.1 | 5.34 (d, 7.8 Hz) | 104.6 |
| $2^{IV}$ | 3.69 (m) | 74.6 | 3.75 (m) | 76.2 |
| $3^{IV}$ | 4.20 (m) | 76.9 | 4.21 (m) | 78.9 |
| $4^{IV}$ | 3.74 (m) | 69.9 | 3.87 (m) | 72.5 |
| $5^{IV}$ | 3.81 (m) | 77.2 | 3.88 (m) | 78.9 |
| $6^{IV}$ | 4.07&3.85 (m) | 61.5 | 4.18 & 3.95 (m) | 63.2 |
| $1^V$ | 5.47 (d, 7.8 Hz) | 103.5 | 5.42 (d, 7.8 Hz) | 104.9 |
| $2^V$ | 3.88 (m) | 74.7 | 3.83 (m) | 75.8 |
| $3^V$ | 3.76 (m) | 77.1 | 3.95 (m) | 78.9 |
| $4^V$ | 3.79 (m) | 73.2 | 3.79 (m) | 74.5 |
| $5^V$ | 3.57 (m) | 76.2 | 3.69 (m) | 78.5 |
| $6^V$ | 4.28 (dd, 11.1 & 4.1 Hz)&4.01 (m) | 63.6 | 4.32 & 4.08 (m) | 64.8 |
| $1^{VI}$ | 5.05 (d, 7.8 Hz) | 103.4 | 5.3 (d, 7.8 Hz) | 105.6 |
| $2^{VI}$ | 3.68 (m) | 76.9 | 3.76 (m) | 76.2 |
| $3^{VI}$ | 4.06 (m) | 77.1 | 3.98 (m) | 78.9 |
| $4^{VI}$ | 3.77 (m) | 70.5 | 3.77 (m) | 72.4 |
| $5^{VI}$ | 3.59 m) | 77.2 | 4.07 (m) | 78.8 |
| $6^{VI}$ | 4.08&3.83 (m) | 61.6 | 4.28 & 3.92 (m) | 63.5 |
| $1^{VII}$ | — | | 5.86 (d, 3.6 Hz) | 100.7 |
| $2^{VII}$ | — | | 3.87 (m) | 74.2 |
| $3^{VII}$ | — | | 4.93 (t, 9.5 Hz) | 75.7 |
| $4^{VII}$ | — | | 3.68 (m) | 74.3 |
| $5^{VII}$ | — | | 4.65 (m) | 74.2 |
| $6^{VII}$ | — | | 4.31 & 4.02 (m) | 64.8 |

Example 5

Analysis of Rebaudioside 7.2

2.5 mg of sample was dissolved in 1 mL of $CDCl_3$/pyridine-d5 1/1 (w/w) and 2 drops of DCOOD.

A series of COSY and TOCSY 2D NMR spectra with small increments of the mixing time afforded the assignment of almost all protons of each spin system (of the seven sugar units) for all three Rebaudiosides as well as the ent-kaurane diterpenoid core. The HSQC experiment allowed for the assigment of corresponding C—H couples.

The anomeric H of $glc^I$ and $glc^{II}$ were identified based on their long range correlation in HMBC to the protons of the ent-kaurane diterpenoid core.

The position of sugars $glc^{III}$, $glc^{IV}$, $glc^V$ and $glc^{VI}$ is identical as in the structure of Rebaudioside M and the assignment is described in more detail in section dedicated to assignment of structure of Rebaudioside 7.1.

Figure 8:
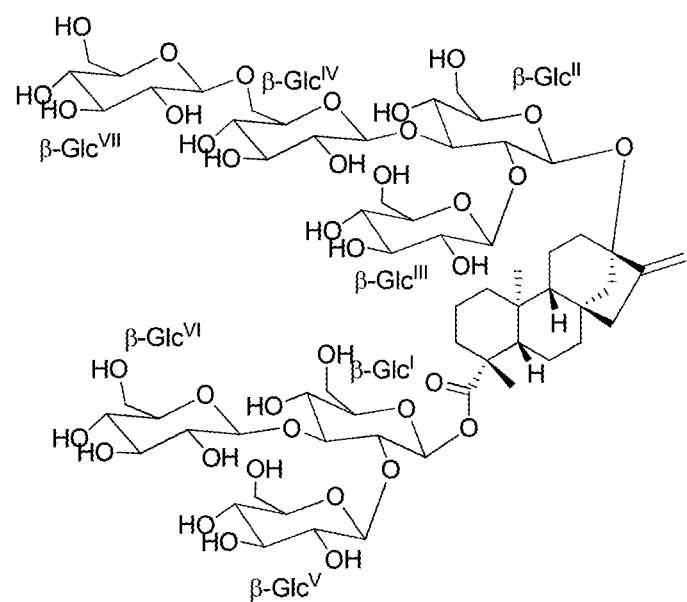
FIG. 8 shows the structure of Rebaudioside 7.2.

The position of the $7^{th}$ sugar in Rebaudioside 7.2 could be identified from the long range HMBC coupling of $H6^{IV}$ and $C1^{VII}$, long range proton coupling of $H1^{VII}$-$H6^{IV}$ in ROESY experiment and the low field shift of the $C6^{IV}$ (69.4 ppm as compared to remaining C6 atoms 62-64 ppm). The $7^{th}$ sugar is attached via β-glycosidic bond to $Glc^{IV}$. The structure of rebaudioside 7.2 is depicted in FIG. 8. All $^1H$ and $^{13}C$ NMR chemical shifts of Rebaudioside 7.2 are listed in Table 12. For the sake of comparison also the data of Rebaudioside M are included.

TABLE 12

$^1H$ and $^{13}C$ NMR chemical shifts of Rebaudioside 7.2 in $CDCl_3$/pyridine 1/1 and 2 drops of DCOOD and Rebaudioside M in $CDCl_3$/pyridine 1/1 and 3 drops of DCOOD recorded at 300K, $\delta_{TMS} = 0$

| Position | Rebaudioside M $^1H$ | $^{13}C$ | Rebaudioside 7.2 $^1H$ | $^{13}C$ |
|---|---|---|---|---|
| 1 | 0.77 (dt, 13.5& 4 Hz)&1.76 (m) | 39 | 0.77 (dt, 13.3& 4 Hz)&1.76 (m) | 39.9 |
| 2 | 1.35&2.12 (m) | 19.1 | 1.35 & (2.13 (m) | 18.6 |
| 3 | 1.0 (dt, 13.2&4.7)&2.14 (m) | 38.2 | 0.99 (dt, 14&4.6) &2.12 (m) | 38.3 |
| 4 | — | 43.8 | — | 43.1 |
| 5 | 1.02 (t, 13 Hz) | 57 | 1.02 (13.1 Hz) | 57.1 |
| 6 | 2.03 (m)&2.17 (m) | 23.2 | 2.02 & 2.15 (m) | 22.7 |
| 7 | 1.37&1.66 (m) | 42.2 | 1.37 (m)&1.66 (m) | 42.3 |
| 8 | — | 40.6 | — | 40 |
| 9 | 0.89 (d, 8.1 Hz) | 54.1 | 0.89 (d, 7.6 Hz) | 54.1 |
| 10 | — | 40 | — | 39.1 |
| 11 | 1.57 &1.68(m) | 19.8 | 1.57 & 1.69 (m) | 19.3 |
| 12 | 1.66&2.43 (m) | 37.9 | 1.64 & 2.42 (m) | 37.9 |
| 13 | — | 87.3 | — | 86.8 |
| 14 | 1.76 (m) &2.49(d, 10.9 Hz) | 42.7 | 1.75 (m)&2.46 (d, 10.9 Hz) | 42.8 |
| 15 | 1.83&1.99 (d, 17.3 Hz) | 45.9 | 1.84 &1.99 (d, 17 Hz) | 45.9 |
| 16 | — | 152.2 | — | 151.6 |
| 17 | 4.78&5.42 (s) | 104.6 | 4.77&5.39 (s) | 104.5 |
| 18 | 1.21 (s) | 27 | 1.22 (s) | 27.5 |
| 19 | — | 176.4 | — | 176.1 |
| 20 | 1.15 (s) | 16.1 | 1.14 (s) | 15.7 |
| $1^I$ | 5.98 (d, 8.3 Hz) | 94.6 | 5.97 (d, 8.4 Hz) | 94.7 |
| $2^I$ | 4.22 (t, 8.6 Hz) | 76.1 | 4.21 (t, 8.8 Hz) | 76.4 |
| $3^I$ | 4.88 (t, 8.7 Hz) | 87.9 | 4.92 (t, 8 Hz) | 87.1 |
| $4^I$ | 3.88 (m) | 69.6 | 3.84 (m) | 70.7 |
| $5^I$ | 3.86 (m) | 77.5 | 3.84 (m) | 76.9 |
| $6^I$ | 4.06 &3.92 (m) | 61.4 | 4.04&3.91 (m) | 61.5 |
| $1^{II}$ | 5.15 (d, 7.7 Hz) | 95.3 | 5.13 (d, 7.4 Hz) | 95.2 |
| $2^{II}$ | 3.81 (m) | 80.8 | 3.78 (m) | 80.5 |
| $3^{II}$ | 4.67 (t, 9 Hz) | 87 | 4.62 (t, 9.1 Hz) | 88 |
| $4^{II}$ | 3.68 (m) | 69.9 | 3.63(m) | 70.5 |
| $5^{II}$ | 3.74 (m) | 77.1 | 3.65 (m) | 76.6 |
| $6^{II}$ | 4.06&3.92 (m) | 62.3 | 4.1&3.99 (m) | 61.9 |
| $1^{III}$ | 5.13 (d, 7.6 Hz) | 104 | 5.04 (d, 8.1 Hz) | 104.3 |
| $2^{III}$ | 3.81 (m) | 74.9 | 3.81 (m) | 74.7 |
| $3^{III}$ | 3.81(m) | 77.8 | 3.76 (m) | 77.6 |
| $4^{III}$ | 3.60 (m) | 72.8 | 3.57 (m) | 73 |
| $5^{III}$ | 3.45 (m) | 76.3 | 3.42 (m) | 76.2 |
| $6^{III}$ | 4.2&3.91 (m) | 63.6 | 4.17&3.91 (m) | 63.8 |
| $1^{IV}$ | 5.147 (d, 8.1 Hz) | 103.1 | 4.94 (d, 8 Hz) | 103.5 |
| $2^{IV}$ | 3.69 (m) | 74.6 | 3.65 (m) | 74.4 |
| $3^{IV}$ | 4.20 (m) | 76.9 | 4.06 (m) | 76.6 |
| $4^{IV}$ | 3.74 (m) | 69.3 | 3.83 (m) | 69.7 |
| $5^{IV}$ | 3.81 (m) | 77.2 | 3.58 (m) | 77.3 |
| $6^{IV}$ | 4.07&3.85 (m) | 61.5 | 4.43 (d, 9.6 Hz)&3.63 (m) | 69.4 |
| $1^V$ | 5.47 (d, 7.8 Hz) | 103.5 | 5.51 (d, 7.4 Hz) | 103.4 |
| $2^V$ | 3.88 (m) | 74.7 | 3.88 (m) | 74.8 |
| $3^V$ | 3.76 (m) | 77.1 | 3.89(m) | 77.6 |
| $4^V$ | 3.79 (m) | 73.2 | 3.77 (m) | 73.3 |
| $5^V$ | 3.57 (m) | 76.2 | 3.55 (m) | 76.1 |
| $6^V$ | 4.28 (dd, 11.1 & 4.1 Hz)&4.01 (m) | 63.6 | 4.25 (dd, 11.1&3.8 Hz)&3.98 (m) | 63.7 |
| $1^{VI}$ | 5.05 (d, 7.8 Hz) | 103.4 | 5.18 (d, 8.1 Hz) | 103.14 |
| $2^{VI}$ | 3.68 (m) | 76.9 | 3.69 (m) | 74.7 |
| $3^{VI}$ | 4.06 (m) | 77.1 | 4.12 (t, 9.1 Hz) | 77.2 |
| $4^{VI}$ | 3.77 (m) | 70.5 | 3.82 (m) | 70.6 |
| $5^{VI}$ | 3.59 m) | 77.2 | 3.71 (m) | 77.2 |

TABLE 12-continued

¹H and ¹³C NMR chemical shifts of Rebaudioside 7.2 in CDCl₃/pyridine 1/1 and 2 drops of DCOOD and Rebaudioside M in CDCl₃/pyridine 1/1 and 3 drops of DCOOD recorded at 300K, $\delta_{TMS} = 0$

| Position | Rebaudioside M ¹H | ¹³C | Rebaudioside 7.2 ¹H | ¹³C |
|---|---|---|---|---|
| $6^{VI}$ | 4.08&3.83 (m) | 61.6 | 4.03&3.82(m) | 61.4 |
| $1^{VII}$ | — | | 4.47 (d, 7.8 Hz) | 103.6 |
| $2^{VII}$ | — | | 3.62 (m) | 74.5 |
| $3^{VII}$ | — | | 3.84 (m) | 77.7 |
| $4^{VII}$ | — | | 3.57 (m) | 75.6 |
| $5^{VII}$ | — | | 3.82 (m) | 77.3 |
| $6^{VII}$ | — | | 4.2&4.06 (m) | 62 |

Example 6

Analysis of Rebaudioside 7.3

2.3 mg of sample was dissolved in 1 mL of CDCl₃/pyridine-d5 1/2 (w/w) and 3 drops of DCOOD.

A series of COSY and TOCSY 2D NMR spectra with small increments of the mixing time afforded the assignment of almost all protons of each spin system (of the seven sugar units) for all three Rebaudiosides as well as the ent-kaurane diterpenoid core. The HSQC experiment allowed for the assigment of corresponding C—H couples.

The anomeric H of glc$^I$ and glc$^{II}$ were identified based on their long range correlation in HMBC to the protons of the ent-kaurane diterpenoid core.

The position of sugars glc$^{III}$, glc$^{IV}$, glc$^V$ and glc$^{VI}$ is identical as in the structure of Rebaudioside M and the assignment is described in more detail in section dedicated to assignment of structure of Rebaudioside 7.1.

Figure 9:
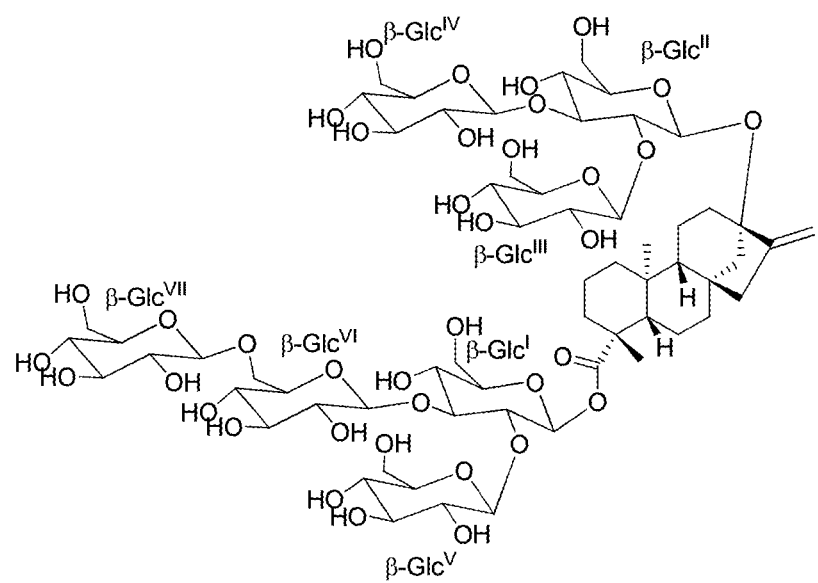
FIG. 9 shows the structure of Rebaudioside 7.3.

The position of the 7$^{th}$ sugar in Rebaudioside 7.3 could be identified from the long range HMBC coupling of H1$^{VII}$ and C6$^{VI}$, long range proton coupling of H1$^{VII}$-H6$^{VI}$ in ROESY experiment and the low field shift of the C6$^{VI}$ (69.5 ppm as compared to remaining C6 atoms 61-63 ppm). The 7$^{th}$ sugar is attached via β-glycosidic bond to Glc$^{VI}$. The structure of rebaudioside 7.3 is depicted in FIG. 9. All ¹H and ¹³C NMR chemical shifts of Rebaudioside 7.3 are listed in Table 13. For the sake of comparison also the data of Rebaudioside M are included.

TABLE 13

¹H and ¹³C NMR chemical shifts of Rebaudioside 7.3 in CDCl₃/pyridine 1/2 and 3 drops of DCOOD and Rebaudioside M in CDCl₃/pyridine 1/1 and 3 drops of DCOOD recorded at 300K, $\delta_{TMS} = 0$

| Position | Rebaudioside M ¹H | ¹³C | Rebaudioside 7.3 ¹H NMR | ¹³C |
|---|---|---|---|---|
| 1 | 0.77 (dt, 13.5& 4 Hz)&1.76 (m) | 39 | 0.79 (dt, 14&4.3 Hz)&1.77 (m) | 39.9 |
| 2 | 1.35&2.12 (m) | 19.1 | 1.38&2.18 (m) | 19.1 |
| 3 | 1.0 (dt, 13.2&4.7)&2.14 (m) | 38.2 | 1.03 (m)&2.17 (m) | 38.1 |
| 4 | — | 43.8 | — | 43.7 |
| 5 | 1.02 (t, 13 Hz) | 57 | 1.04 (t, 12.8 Hz) | 57 |
| 6 | 2.03 (m)&2.17 (m) | 23.2 | 2.09&2.21 (m) | 23.3 |
| 7 | 1.37&1.66 (m) | 42.2 | 1.41&1.69 (m) | 42.1 |
| 8 | — | 40.6 | — | 40.5 |
| 9 | 0.89 (d, 8.1 Hz) | 54.1 | 0.91 (d, 8 Hz) | 53.9 |
| 10 | — | 40 | — | 39.4 |
| 11 | 1.57 &1.68(m) | 19.8 | 1.59&1.72 (m) | 19.9 |
| 12 | 1.66&2.43 (m) | 37.9 | 1.68&2.48 (m) | 38 |
| 13 | — | 87.3 | — | 87.4 |
| 14 | 1.76 (m) &2.49(d, 10.9 Hz) | 42.7 | 1.81 (d, 10.4 Hz)&2.53 (d, 10.4 Hz) | 42.1 |
| 15 | 1.83&1.99 (d, 17.3 Hz) | 45.9 | 1.87 (d, 17.9 Hz)&2.01 (d, 17.9 Hz) | 46 |
| 16 | — | 152.2 | — | 152.3 |
| 17 | 4.78&5.42 (s) | 104.6 | 4.84&5.47 (s) | 104.6 |
| 18 | 1.21 (s) | 27 | 1.27 (s) | 27.9 |
| 19 | — | 176.4 | — | 176.3 |
| 20 | 1.15 (s) | 16.1 | 1.2 (s) | 16.4 |
| $1^I$ | 5.98 (d, 8.3 Hz) | 94.6 | 6.06 (d, 8.6 Hz) | 94.5 |
| $2^I$ | 4.22 (t, 8.6 Hz) | 76.1 | 4.29 (t, 8.7 Hz) | 76.1 |
| $3^I$ | 4.88 (t, 8.7 Hz) | 87.9 | 4.87 (t, 8.7 Hz) | 88.6 |
| $4^I$ | 3.88 (m) | 69.6 | 3.99 (m) | 69.3 |
| $5^I$ | 3.86 (m) | 77.5 | 3.89 (m) | 77.3 |
| $6^I$ | 4.06 &3.92 (m) | 61.4 | 4.04&4.10 (m) | 61 |
| $1^{II}$ | 5.15 (d, 7.7 Hz) | 95.3 | 5.19 (d, 7.1 Hz) | 95.4 |
| $2^{II}$ | 3.81 (m) | 80.8 | 3.87 (m) | 80.8 |
| $3^{II}$ | 4.67 (t, 9 Hz) | 87 | 4.72 (t, 9.5 Hz) | 86.9 |
| $4^{II}$ | 3.68 (m) | 69.9 | 3.81 (m) | 69.6 |
| $5^{II}$ | 3.74 (m) | 77.1 | 3.70 (m) | 77 |
| $6^{II}$ | 4.06&3.92 (m) | 62.3 | 4.10&3.99 (m) | 61.9 |
| $1^{III}$ | 5.13 (d, 7.6 Hz) | 104 | 5.22 (d, 7.4 Hz) | 104.1 |
| $2^{III}$ | 3.81 (m) | 74.9 | 3.90 (m) | 74.9 |
| $3^{III}$ | 3.81(m) | 77.8 | 3.92 (m) | 77.6 |

TABLE 13-continued $^1$H and $^{13}$C NMR chemical shifts of Rebaudioside 7.3 in CDCl$_3$/pyridine 1/2 and 3 drops of DCOOD and Rebaudioside M in CDCl$_3$/pyridine 1/1 and 3 drops of DCOOD recorded at 300K, $\delta_{TMS} = 0$

| Position | Rebaudioside M $^1$H | $^{13}$C | Rebaudioside 7.3 $^1$H NMR | $^{13}$C |
|---|---|---|---|---|
| $4^{III}$ | 3.60 (m) | 72.8 | 3.65 (m) | 72.7 |
| $5^{III}$ | 3.45 (m) | 76.3 | 3.55 (m) | 76.8 |
| $6^{III}$ | 4.2&3.91 (m) | 63.6 | 4.27 &3.99 (m) | 63.4 |
| $1^{IV}$ | 5.147 (d, 8.1 Hz) | 103.1 | 5.32 (d, 8.0 Hz) | 103.2 |
| $2^{IV}$ | 3.69 (m) | 74.6 | 3.77 (m) | 74.8 |
| $3^{IV}$ | 4.20 (m) | 76.9 | 4.23 (m) | 77.3 |
| $4^{IV}$ | 3.74 (m) | 69.9 | 3.89 (m) | 70.7 |
| $5^{IV}$ | 3.81 (m) | 77.2 | 3.90 (m) | 77.5 |
| $6^{IV}$ | 4.07&3.85 (m) | 61.5 | 4.15 (d, 11.3 Hz)&3.91 (m) | 61.5 |
| $1^{V}$ | 5.47 (d, 7.8 Hz) | 103.5 | 5.53 (d, 7.8 Hz) | 103.5 |
| $2^{V}$ | 3.88 (m) | 74.7 | 3.91 (m) | 74.9 |
| $3^{V}$ | 3.76 (m) | 77.1 | 3.93 (m) | 77.6 |
| $4^{V}$ | 3.79 (m) | 73.2 | 3.84 (m) | 73 |
| $5^{V}$ | 3.57 (m) | 76.2 | 3.66 (m) | 77.3 |
| $6^{V}$ | 4.28 (dd, 11.1 & 4.1 Hz)&4.01 (m) | 63.6 | 4.37 (dd, 12&4.3 Hz)&4.08 (m) | 63.4 |
| $1^{VI}$ | 5.05 (d, 7.8 Hz) | 103.4 | 5.08 (d, 8.0 Hz) | 103.6 |
| $2^{VI}$ | 3.68 (m) | 76.9 | 3.74 (m) | 74.4 |
| $3^{VI}$ | 4.06 (m) | 77.1 | 4.09 (m) | 77.1 |
| $4^{VI}$ | 3.77 (m) | 70.5 | 3.70 (m) | 70.6 |
| $5^{VI}$ | 3.59 m) | 77.2 | 3.71 (m) | 75.9 |
| $6^{VI}$ | 4.08&3.83 (m) | 61.6 | 4.52 (d, 8.7 Hz)&3.70 (m) | 69.5 |
| $1^{VII}$ | — | | 4.59 (d, 7.8 Hz) | 103.6 |
| $2^{VII}$ | — | | 3.68 (m) | 74.6 |
| $3^{VII}$ | — | | 3.93 (m) | 77 |
| $4^{VII}$ | — | | 3.91 (m) | 70.7 |
| $5^{VII}$ | — | | 3.67 (m) | 76.7 |
| $6^{VII}$ | — | | 4.21 (m)&4.1 (m) | 61.8 |

In summary, three new rebaudiosides were determined as set out in Table 14.

TABLE 14

Summary of new Rebaudiosides

| Steviol glycosides compound | R$_1$ | R$_2$ |
|---|---|---|
| 7.1 | β-glc-β-glc(2→1)-α-glc(3→1) <br> β-glc(3→1) | β-glc-β-glc(2→1) <br> β-glc(3→1) |
| 7.2 | β-glc-β-glc(2→1) <br> β-glc(3→1)-β-glc(6→1) | β-glc-β-glc(2→1) <br> β-glc(3→1) |
| 7.3 | β-glc-β-glc(2→1) <br> β-glc(3→1) | β-glc-β-glc(2→1) <br> β-glc(3→1)-β-glc(6→1) |

General Materials and Methods (NMR Analysis)

Figure 12:
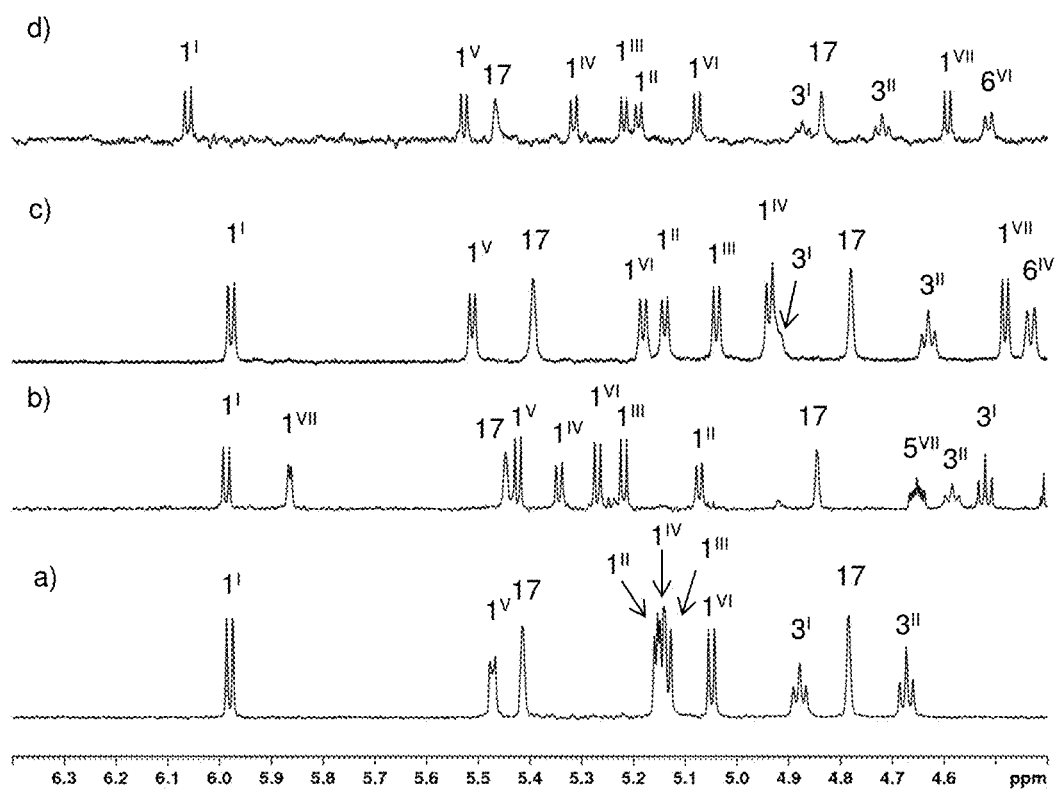
FIG. 12 shows the selected region of the 1H NMR spectrum of a) Reb M (cdcl3/pyr 1:1, 2 drops cdood at 300K), b) Reb 7.1 (cdcl3/pyr 1:3, 2 drops cdood at 320K) c) Reb 7.2 (cdcl3/pyr 1:1, 2 drops cdood at 300K) and d) Reb 7.3 (cdcl3/pyr 1:2, 3 drops cdood at 300K).

The solvent mixture was optimized for each of the Rebaudioside samples to obtain the best possible resolution of the signals of the anomeric protons. The amount of samples and the amount of solvent is critical for the resolution of the peaks as the shift of the peaks, especially the anomeric ones, are concentration and pH dependent (FIG. 12).

The spectra of Rebaudiosides 7.2 and 7.3 were recorded at 300K while in case of Rebaudioside 7.1 higher temperature had to be used. At 300K the resonances in the spectrum of Rebaudioside 7.1 were rather broad, indicating either bad solubility or slow conformational processes. Therefore, the final assignment of all signals was achieved at a sample temperature of 320K.

For each example, various 2D NMR experiments were conducted: COSY, TOCSY (with 40, 50, 60, 70, 80, 90 and 100 ms mixing time), HSQC, HMBC and ROESY (225, 400 ms mixing time) spectra were recorded at 320 K on a Bruker Avance III 600 and 700 MHz spectrometer. The detailed assignment for each example is specified in the example section.

Figure 11A:
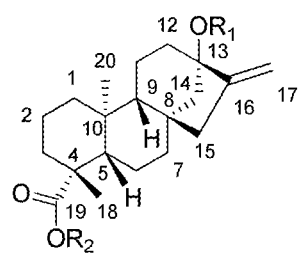
FIG. 11A shows atom numbering of steviol.
Figure 11B:
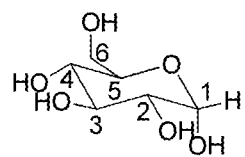
FIG. 11B shows atom numbering of glucose.

In Examples 4, 5 and 6, the atom numbering of steviol and glucose is as set out in FIGS. 11A and 11B, respectively.

TABLE 15

Description of the sequence listing

| Nucleic acid (CpO for *S. cerevisiae*) | Nucleic acid (CpO for *Y. lipolytica*) | Amino acid | Id* | UniProt^ | Organism |
|---|---|---|---|---|---|
| SEQ ID NO: 1 | SEQ ID NO: 151 | SEQ ID NO: 2 | CPS_1 | Q9FXV9 | *Lactuca sativa* (Garden Lettuce) |
| SEQ ID NO: 3 | SEQ ID NO: 152 | SEQ ID NO: 4 | tCPS_1 | Q9FXV9 | *Lactuca sativa* (Garden Lettuce) |
| SEQ ID NO: 5 | SEQ ID NO: 153 | SEQ ID NO: 6 | CPS_2 | D2X8G0 | *Picea glauca* |

TABLE 15-continued

Description of the sequence listing

| Nucleic acid (CpO for *S. cerevisiae*) | Nucleic acid (CpO for *Y. lipolytica*) | Amino acid | Id* | UniProt^ | Organism |
| --- | --- | --- | --- | --- | --- |
| SEQ ID NO: 7 | SEQ ID NO: 154 | SEQ ID NO: 8 | CPS_3 | Q45221 | *Bradyrhizobium japonicum* |
| SEQ ID NO: 9 | SEQ ID NO: 155 | SEQ ID NO: 10 | KS_1 | Q9FXV8 | *Lactuca sativa* (Garden Lettuce) |
| SEQ ID NO: 11 | SEQ ID NO: 156 | SEQ ID NO: 12 | tKS_1 | Q9FXV8 | *Lactuca sativa* (Garden Lettuce) |
| SEQ ID NO: 13 | SEQ ID NO: 157 | SEQ ID NO: 14 | KS_2 | D2X8G1 | *Picea glauca* |
| SEQ ID NO: 15 | SEQ ID NO: 158 | SEQ ID NO: 16 | KS_3 | Q45222 | *Bradyrhizobium japonicum* |
| SEQ ID NO: 17 | SEQ ID NO: 159 | SEQ ID NO: 18 | CPSKS_1 | O13284 | *Phaeosphaeria sp* |
| SEQ ID NO: 19 | SEQ ID NO: 160 | SEQ ID NO: 20 | CPSKS_2 | Q9UVY5 | *Gibberella fujikuroi* |
| SEQ ID NO: 21 | SEQ ID NO: 161 | SEQ ID NO: 22 | KO_1 | B5MEX5 | *Lactuca sativa* (Garden Lettuce) |
| SEQ ID NO: 23 | SEQ ID NO: 162 | SEQ ID NO: 24 | KO_2 | B5MEX6 | *Lactuca sativa* (Garden Lettuce) |
| SEQ ID NO: 25 | SEQ ID NO: 163 | SEQ ID NO: 26 | KO_3 | B5DBY4 | *Sphaceloma manihoticola* |
| SEQ ID NO: 27 | SEQ ID NO: 164 | SEQ ID NO: 28 | KAH_1 | Q2HYU7 | *Artemisia annua* (Sweet wormwood). |
| SEQ ID NO: 29 | SEQ ID NO: 165 | SEQ ID NO: 30 | KAH_2 | B9SBP0 | *Ricinus communis* (Castor bean). |
| SEQ ID NO: 31 | SEQ ID NO: 166 | SEQ ID NO: 32 | KAH_3 | Q0NZP1 | *Stevia rebaudiana* |
| SEQ ID NO: 33 | SEQ ID NO: 167 | SEQ ID NO: 34 | KAH_4 | JP2009065886 | *Arabidopsis thaliana* (Mouse-ear cress) |
| SEQ ID NO: 35 | SEQ ID NO: 168 | SEQ ID NO: 36 | UGT1_1 | A9X3L6 | *Ixeris dentata* var. albiflora. |
| SEQ ID NO: 37 | SEQ ID NO: 169 | SEQ ID NO: 38 | UGT1_2 | B9SIN2 | *Ricinus communis* (Castor bean). |
| SEQ ID NO: 39 | SEQ ID NO: 170 | SEQ ID NO: 40 | UGT3_1 | A9X3L7 | *Ixeris dentata* var. Albiflora |
| SEQ ID NO: 41 | SEQ ID NO: 171 | SEQ ID NO: 42 | UGT3_2 | B9IEM5 | *Populus trichocarpa* (Western balsam poplar) |
| SEQ ID NO: 43 | SEQ ID NO: 172 | SEQ ID NO: 44 | UGT3_3 | Q9M6E7 | *Nicotiana tabacum* |
| SEQ ID NO: 45 | SEQ ID NO: 173 | SEQ ID NO: 46 | UGT3_4 | A3E7Y9 | *Vaccaria hispanica* |
| SEQ ID NO: 47 | SEQ ID NO: 174 | SEQ ID NO: 48 | UGT3_5 | P10249 | *Streptococcus mutans* |
| SEQ ID NO: 49 | SEQ ID NO: 175 | SEQ ID NO: 50 | UGT4_1 | A4F1T4 | *Lobelia erinus* (Edging lobelia) |
| SEQ ID NO: 51 | SEQ ID NO: 176 | SEQ ID NO: 52 | UGT4_2 | Q9M052 | *Arabidopsis thaliana* (Mouse-ear cress) |
| SEQ ID NO: 53 | SEQ ID NO: 177 | SEQ ID NO: 54 | CPR_1 | Q7Z8R1 | *Gibberella fujikuroi* |
| SEQ ID NO: 55 | SEQ ID NO: 178 | SEQ ID NO: 56 | CPR_2 | Q9SB48 | *Arabidopsis thaliana* (Mouse-ear cress) |
| SEQ ID NO: 57 | SEQ ID NO: 179 | SEQ ID NO: 58 | CPR_3 | Q9SUM3 | *Arabidopsis thaliana* (Mouse-ear cress) |
| SEQ ID NO: 59 | SEQ ID NO: 141 | SEQ ID NO: 60 | CPS_SR | O22667 | *Stevia rebaudiana* |
| SEQ ID NO: 61 | SEQ ID NO: 142 | SEQ ID NO: 62 | tCPS_SR | O22667 | *Stevia rebaudiana* |
| SEQ ID NO: 63 | SEQ ID NO: 143 | SEQ ID NO: 64 | KS_SR | Q9XEI0 | *Stevia rebaudiana* |
| SEQ ID NO: 65 | SEQ ID NO: 144 | SEQ ID NO: 66 | tKS_SR | Q9XEI0 | *Stevia rebaudiana* |
| SEQ ID NO: 67 | SEQ ID NO: 145 | SEQ ID NO: 68 | KO_SR | Q4VCL5 | *Stevia rebaudiana* |
| SEQ ID NO: 69 | SEQ ID NO: 146 | SEQ ID NO: 70 | KAH_SR | US7927851 | *Stevia rebaudiana* |
| SEQ ID NO: 71 | SEQ ID NO: 147 | SEQ ID NO: 72 | UGT1_SR | Q6VAB0 | *Stevia rebaudiana* |
| SEQ ID NO: 73 | SEQ ID NO: 148 | SEQ ID NO: 74 | UGT3_SR | Q6VAA6 | *Stevia rebaudiana* |
| SEQ ID NO: 75 | SEQ ID NO: 149 | SEQ ID NO: 76 | UGT4_SR | Q6VAB4 | *Stevia rebaudiana* |

TABLE 15-continued

Description of the sequence listing

| Nucleic acid (CpO for *S. cerevisiae*) | Nucleic acid (CpO for *Y. lipolytica*) | Amino acid | Id* | UniProt^ | Organism |
|---|---|---|---|---|---|
| SEQ ID NO: 77 | SEQ ID NO: 150 | SEQ ID NO: 78 | CPR_SR | Q2I6J8 | *Stevia rebaudiana* |
| SEQ ID NO: 79 | | SEQ ID NO: 80 | tHMG1 | G2WJY0 | *Saccharomyces cerevisiae* |
| SEQ ID NO: 81 | | SEQ ID NO: 82 | ERG20 | E7LW73 | *Saccharomyces cerevisiae* |
| SEQ ID NO: 83 | | SEQ ID NO: 84 | BTS1 | E7Q9V5 | *Saccharomyces cerevisiae* |
| SEQ ID NO: 85 | SEQ ID NO: 180 | SEQ ID NO: 86 | KO_Gibfu | O94142 | *Gibberella fujikuroi* |
| SEQ ID NO: 87 | SEQ ID NO: 181 | SEQ ID NO: 88 | UGT2_1a | B3VI56/99% | *Stevia rebaudiana* |
| SEQ iD NO: 89 | | SEQ ID NO: 90 | KAH_ASR1 | Xxx | *S. rebaudiana* |
| SEQ ID NO: 91 | | SEQ ID NO: 92 | KAH_ASR2 | Q0NZP1_STERE | *S. rebaudiana* |
| SEQ ID NO: 93 | | SEQ ID NO: 94 | KAH_AAT | Q6NKZ8_ARATH | *A. thaliana* |
| SEQ ID NO: 95 | | SEQ ID NO: 96 | KAH_AVV | F6H1G0_VITVI/98% | *Vitis vinifera* |
| SEQ ID NO: 97 | | SEQ ID NO: 98 | KAH_AMT | Q2MJ20_MEDTR | *Medicago truncatula* |
| SEQ ID NO: 99 | | SEQ ID NO: 100 | UGT2_1b | B3VI56/99% | *S. rebaudiana* |
| SEQ ID NO: 101 | | SEQ ID NO: 102 | UGT2_2 | Q53UH5_IPOPU | *I. purpurea* |
| SEQ ID NO: 103 | | SEQ ID NO: 104 | UGT2_3 | UGAT_BELPE/99% | *Bellis perennis* |
| SEQ ID NO: 105 | | SEQ ID NO: 106 | UGT2_4 | B3VI56 | *S. rebaudiana* |
| SEQ iD NO: 107 | | SEQ ID NO: 108 | UGT2_5 | Q6VAA8 | *S. rebaudiana* |
| SEQ ID NO: 109 | | SEQ ID NO: 110 | UGT2_6 | Q8LKG3 | *S. rebaudiana* |
| SEQ ID NO: 111 | | SEQ ID NO: 112 | UGT2_7 | B9HSH7_POPTR | *Populus trichocarpa* |
| SEQ ID NO: 113 | | SEQ ID NO: 114 | UGT_RD1 | Q6VAA3 | *S. rebaudiana* |
| SEQ ID NO: 115 | | SEQ ID NO: 116 | UGT_RD2 | Q8H6A4 | *S. rebaudiana* |
| SEQ ID NO: 117 | | SEQ ID NO: 118 | UGT_RD3 | Q6VAA4 | *S. rebaudiana* |
| SEQ ID NO: 119 | | SEQ ID NO: 120 | UGT_RD4 | Q6VAA5 | *S. rebaudiana* |
| SEQ ID NO: 121 | | SEQ ID NO: 122 | UGT_RD5 | Q6VAA7 | *S. rebaudiana* |
| SEQ ID NO: 123 | | SEQ ID NO: 124 | UGT_RD6 | Q6VAA8 | *S. rebaudiana* |
| SEQ ID NO: 125 | | SEQ ID NO: 126 | UGT_RD7 | Q6VAA9 | *S. rebaudiana* |
| SEQ ID NO: 127 | | SEQ ID NO: 128 | UGT_RD8 | Q6VAB1 | *S. rebaudiana* |
| SEQ ID NO: 129 | | SEQ ID NO: 130 | UGT_RD9 | Q6VAB2 | *S. rebaudiana* |
| SEQ ID NO: 131 | | SEQ ID NO: 132 | UGT_RD10 | Q6VAB3 | *S. rebaudiana* |
| SEQ ID NO: 133 | | SEQ ID NO: 134 | UGT_RD11 | B9VVB1 | *S. rebaudiana* |
| SEQ ID NO: 135 | | SEQ ID NO: 136 | UGT_RD12 | C7EA09 | *S. rebaudiana* |
| SEQ ID NO: 137 | | SEQ ID NO: 138 | UGT_RD13 | Q8LKG3 | *S. rebaudiana* |
| SEQ ID NO: 139 | | SEQ ID NO: 140 | UGT_RD14 | B3VI56 | *S. rebaudiana* |
| | | SEQ ID NO: 182 | tCPS | | |
| | | SEQ ID NO: 183 | tKS | | |
| | | SEQ ID NO: 184 | CPSKS | | |

TABLE 15-continued

Description of the sequence listing

| Nucleic acid (CpO for *S. cerevisiae*) | Nucleic acid (CpO for *Y. lipolytica*) | Amino acid | Id* | UniProt^ | Organism |
|---|---|---|---|---|---|
| | SEQ ID NO: 185 | | KAH4 | | |
| | SEQ ID NO: 186 | | KO_Gibfu | | |
| | SEQ ID NO: 187 | | CPR1 | | |
| | SEQ ID NO: 188 | | CPR3 | | |
| | SEQ ID NO: 189 | | UGT1 | | |
| | SEQ ID NO: 190 | | UGT3 | | |
| | SEQ ID NO: 191 | | UGT4 | | |
| | SEQ ID NO: 192 | | UGT2_1a | | |
| | SEQ ID NO: 193 | | pTPI | | |
| | SEQ ID NO: 194 | | gpdT-pGPD | | |
| | SEQ ID NO: 195 | | pgmT-pTEF | | |
| | SEQ ID NO: 196 | | pgkT-pPGM | | |
| | SEQ ID NO: 197 | | LEU2 and flanking sequences | | |
| | SEQ ID NO: 198 | | vector sequences | | |
| | SEQ ID NO: 199 | | pENO | | |
| | SEQ ID NO: 200 | | HPH | | |
| SEQ ID NO: 201 | | | Sc Eno2.pro | | |
| SEQ ID NO: 202 | | | Sc Fba1.pro | | |
| SEQ ID NO: 203 | | | Sc Tef1.pro | | |
| SEQ ID NO: 204 | | | Sc Pgk1.pro | | |
| SEQ ID NO: 205 | | | Kl prom 12.pro | | |
| SEQ ID NO: 206 | | | Ag lox_TEF1.pro | | |
| SEQ ID NO: 207 | | | Kl prom 6.pro | | |
| SEQ ID NO: 208 | | | Sc Pma1.pro | | |
| SEQ ID NO: 209 | | | Sc Vps68.pro | | |
| SEQ ID NO: 210 | | | Sc Oye2.pro | | |
| SEQ ID NO: 211 | | | KANMX ORF | | |
| SEQ ID NO: 212 | | | Adh1.ter | | |
| SEQ ID NO: 213 | | | Adh2.ter | | |
| SEQ ID NO: 214 | | | Gmp1.ter | | |
| SEQ ID NO: 215 | | | Sc Tal1.ter | | |
| SEQ ID NO: 216 | | | Sc Tpi1.ter | | |
| SEQ ID NO: 217 | | | Ag Tef1_lox.ter | | |
| SEQ ID NO: 218 | | | Sc Pdc1.ter | | |
| SEQ ID NO: 219 | | | Sc Tdh1.ter | | |
| SEQ ID NO: 220 | | | Sc Eno1.ter | | |

TABLE 15-continued

Description of the sequence listing

| Nucleic acid (CpO for S. cerevisiae) | Nucleic acid (CpO for Y. lipolytica) | Amino acid | Id* | UniProt^ | Organism |
|---|---|---|---|---|---|
| SEQ ID NO: 221 | | | Kl prom3.pro | | |
| SEQ ID NO: 222 | | | Kl prom2.pro | | |
| SEQ ID NO: 223 | | | Sc PRE3. Pro | | | greyed out ids are truncated and thus a fragment of mentioned UniProt id

SEQUENCE LISTING (223 sequences)

SEQ ID NO: 1 - DNA, 2397 bp, Lactuca sativa
  CDS (1)..(2397)
atgaaaaccatgatttcttctccaatcccagctttccacccaagattttctccagctgctggttccagaagattatctccaatcttgccatcttccggttctgttgtcttgactggttccaagactcaatgtaaggccgtttctaaatctccaactcaagaatactttgatgttttgcaaaagaacggtttgccattcatcaactggcaaaacgatgtcgttgaagatgaattggacaaggaaaagaagatcttgtacccaaacgacgaaatcaagggtttcgttgaaagaatcaaagttatgttaggttccatggacgaaggtgaaatcactgtctctgcttatgacaccgcttgggttgctttggtccaagatatcgatggtaacggtagaccagaatttccttcttctctagaatggatcgtcaagaaccaattatccgatggttcctggggtgaccatttgatcttctctgctcacgacagaatcattaacactttggcttgtgtcattgctttgacttcctggaacgttcatccaggtaagtgtcaaaagggtttaaagttcttgaacgacaacatctccaagttggaagaagaaaacccagaacacatgccaatcggttttgaagttgctttcccatctttgattgatattgccagaaagttggatatccaagttccagaagattccccagctttgaaggaaatttacgccagaagaaacttgaaattgaccaagattccaaagtctttgatgcacaaggttccaactactttgttgcattctttggaaggtatgccagacttggaatgggaaaagttgttgaagctacaatgtaaggatggttctttcttgttctctccatcttccactgctttcgctttgatgcaaaccaaggaccaaaagtgtttgcaatacttgactgacgctgtcaccaagttcaacggtggtgttccaaacgtctacccagtcgacttgttcgaacacatctgggttgttgacagattgcaaagattaggtatctccagatacttcgactctgaaatcaaagactgtgtcgactacatctacagatactggaccaaggatggtatctgttgggctaagaactccaacgttcaagatattgatgacaccgctatgggtttcagagttttgagaatgcacggttacaaggtcactactgatgttttccgtcaattcgaaaaggacggtaaattcgtttgtttcccaggtcaaaccacccaagctgtcaccggtatgttcaacttgtttagagcttctcaagtcttgttcccagacgaaaagattttggaagatgctaagaaattctcttacaactacttgaaggaaaagcaatccaccaacgaattattggacaaatggatcattgccaaggacttgccaggtgaagttgaatacgctttagatgttccatggtacgcttccttgccacgtttggaaaccagattctacttggaacaatacggtggtgaagatgacgtctggatcggtaagactttgtacagaatgggtaatgtctccaacaacacctacttggaaatggccaaattggactacaacaactgtttggccattcatcacttggaatggaacaccatgcaacaatggtacgttgacttcggtatggaaagattcggtacttctgatatcacttctctattagtctcttactacttggctgctgcctccgtctttgaacctgaacgttctaaggaaagaattgcttgggctaagaccaccactttggttgacaccatctcttctttcttccactccttgaagatctctaacgaacaccgtcgtgaattcgttgaagaattcagaaacatctccaactccatccaccacgctaagtacggtaagccatggcacggtttgatggttgctttgaaaggtactttacacgaaattgccttggatgtcttgatgactcacagaagagacattcaccctcaattgcaccatgcttgggaaatgtggttgatgagatggcaacaaggtgtcgatgccactgaaggtcaagctgaattaattgttcaaaccatcaacatgactgctggtagatgggtttccaatgaattattggctcacccacaatacagattattgtcctctgtcatcaacaatatctgtcacgaaatctaccacaacagaacctgtatggaagtcaactctaccaccatttccacttctattgactccaagatgcaagaattggttcaattagtcttgtctgactctttggacgacttggaccaagatttgaagcaaaccttcttgactgttgccaagactttctactacaaggcttactgtgacccagaaaccatcaacgttcacatttctaaggtcatgttcgaaaccattatt

SEQ ID NO: 2 - protein, 799 aa, Lactuca sativa
MKTMISSPIPAFHPRFSPAAGSRRLSPILPSSGSVVLTGSKTQCKAVSKSPTQEYFDVLQKNGLPFINWQNDVVEDELDKEKKILYPNDEIKGFVERIKVMLGSMDEGEITVSAYDTAWVALVQDIDGNGRPEFPSSLEWIVKNQLSDGSWGDHLIFSAHDRIINTLACVIALTSWNVHPGKCQKGLKFLNDNISKLEEENPEHMPIGFEVAFPSLIDIARKLDIQVPEDSPALKEIYARRNLKLTKIPKSLMHKVPTTLLHSLEGMPDLEWEKLLKLQCKDGSFLFSPSSTAFALMQTKDQKCLQYLTDAVTKFNGGVPNVYPVDLFEHIWVVDRLQRLGISRYFDSEIKDCVDYIYRYWTKDGICWAKNSNVQDIDDTAMGFRVLRMHGYKVTTDVFRQFEKDGKFVCFPGQTTQAVTGMFNLFRASQVLFPDEKILEDAKKFSYNYLKEKQSTNELLDKWIIAKDLPGEVEYALDVPWYASLPRLETRFYLEQYGGEDDVWIGKTLYRMGNVSNNTYLEMAKLDYNNCLAIHHLEWNTMQQWYVDFGMERFGTSDITSLLVSYYLAAASVFEPERSKERIAWAKTTTLVDTISSFFHSLKISNEHRREFVEEFRNISNSIHHAKYGKPWHGLMVALKGTLHEIALDVLMTHRRDIHPQLHHAWEMWLMRWQQGVDATEGQAELIVQTINMTAGRWVSNELLAHPQYRLLSSVINNICHEIYHNRTCMEVNSTTISTSIDSKMQELVQLVLSDSLDDLDQDLKQTFLTVAKTFYYKAYCDPETINVHISKVMFETII

SEQ ID NO: 3 - DNA, 2271 bp, Lactuca sativa
  CDS (1)..(2271)
atgtgtaaggccgtttctaaatctccaactcaagaatactttgatgttttgcaaaagaacggtttgccattcatcaactggcaaaacgatgtcgttgaagatgaattggacaaggaaaagaagatcttgtacccaaacgacgaaatcaagggtttcgttgaaagaatcaaagttatgttaggttccatggacgaaggtgaaatcactgtctctgcttatgacaccgcttgggttgctttggtccaagatatcgatggtaacggtagaccagaatttccttcttctctagaatggatcgtcaagaaccaattatccgatggttcctggggtgaccatttgatcttctctgctcacgacagaatcattaacactttggcttgtgtcattgctttgacttcctggaacgttcatccaggtaagtgtcaaaagggtttaaagttcttgaacgacaacatctccaagttggaagaagaaaacccagaacacatgccaatcggttttgaagttgctttcccatctttgattgatattgccagaaagttggatatccaagttccagaagattccccagctttgaaggaaatttacgccagaagaaacttgaaattgaccaagattccaaagtctttgatgcacaaggttccaactactttgttgcattctttggaaggtatgccagacttggaatgggaaaagttgttgaagctacaatgtaaggatggttctttcttgttctctccatcttccactgctttcgctttgatgcaaaccaaggaccaaaagtgtttgcaatacttgactgacgctgtcaccaagttcaacggtggtgttccaaacgtctacccagtcgacttgttcgaacacatctgggttgttgacagattgcaaagattaggtatctccagatacttcgactctgaaatcaaagactgtgtcgactacatctacagatactggaccaaggatggtatctgttgggctaagaactccaacgttcaagatattgatgacaccgctatgggtttcagagttttgagaatgcacggttacaaggtcactactgatgttttccgtcaattcgaaaaggacggtaaattcgtttgtttcccaggtcaaaccacccaagctgtcaccggtatgttcaacttgtttagagcttctcaagtcttgttcccagacgaaaagattttggaagatgctaagaaattctcttacaactacttgaaggaaaagcaatccaccaacgaattattggacaaatggatcattgccaaggacttgccaggtgaagttgaatacgctttagatgttccatggtacgcttccttgccacgtttggaaaccagattctacttggaacaatacggtggtgaagatgacgtctggatcggtaagactttgtacagaatgggtaatgtctccaacaacacctacttggaaatggccaaattggactacaacaactgtttggccattcatcacttggaatggaacaccatgcaacaatggtacgttgacttcggtatggaaagattcggtacttctgatatcacttctctattagtctcttactacttggctgctgcctccgtctttgaacctgaacgttctaaggaaagaattgcttgggctaagaccaccactttggttgacaccatctcttctttcttccactccttgaagatctctaacgaacaccgtcgtgaattcgttgaagaattcagaaacatctccaactccatccaccacgctaagtacggtaagccatggcacggtttgatggttgctttgaaaggtactttacacgaaattgccttggatgtcttgatgactcacagaagagacattcaccctcaattgcaccatgcttgggaaatgtggttgatgagatggcaacaaggtgtcgatgccactgaaggtcaagctgaattaattgttcaaaccatcaacatgactgctggtagatgggtttccaatgaattattggctcacccacaatacagattattgtcctctgtcatcaacaatatctgtcacgaaatctaccacaacagaacctgtatggaagtcaactctaccaccatttccacttctattgactccaagatgcaagaattggttcaattagtcttgtctgactctttggacgacttggaccaagatttgaagcaaaccttcttgactgttgccaagactttctactacaaggcttactgtgacccagaaaccatcaacgttcacatttctaaggtcatgttcgaaaccattatt

SEQ ID NO: 4 - protein, 757 aa, Lactuca sativa
MCKAVSKSPTQEYFDVLQKNGLPFINWQNDVVEDELDKEKKILYPNDEIKGFVERIKVMLGSMDEGEITVSAYDTAWVALVQDIDGNGRPEFPSSLEWIVKNQLSDGSWGDHLIFSAHDRIINTLACVIALTSWNVHPGKCQKGLKFLNDNISKLEEENPEHMPIGFEVAFPSLIDIARKLDIQVPEDSPALKEIYARRNLKLTKIPKSLMHKVPTTLLHSLEGMPDLEWEKLLKLQCKDGSFLFSPSSTAFALMQTKDQKCLQYLTDAVTKFNGGVPNVYPVDLFEHIWVVDRLQRLGISRYFDSEIKDCVDYIYRYWTKDGICWAKNSNVQDIDDTAMGFRVLRMHGYKVTTDVFRQFEKDGKFVCFPGQTTQAVTGMFNLFRASQVLFPDEKILEDAKKFSYNYLKEKQSTNELLDKWIIAKDLPGEVEYALDVPWYASLPRLETRFYLEQYGGEDDVWIGKTLYRMGNVSNNTYLEMAKLDYNNCLAIHHLEWNTMQQWYVDFGMERFGTSDITSLLVSYYLAAASVFEPERSKERIAWAKTTTLVDTISSFFHSLKISNEHRREFVEEFRNISNSIHHAKYGKPWHGLMVALKGTLHEIALDVLMTHRRDIHPQLHHAWEMWLMRWQQGVDATEGQAELIVQTINMTAGRWVSNELLAHPQYRLLSSVINNICHEIYHNRTCMEVNSTTISTSIDSKMQELVQLVLSDSLDDLDQDLKQTFLTVAKTFYYKAYCDPETINVHISKVMFETII

SEQ ID NO: 5 - DNA, 2283 bp, Picea glauca
  CDS (1)..(2283)
atgaagatgtccaagtctgttgaagtccaacactgtgctgtccaattcttgtcttccaccaccgatcaaatcgaaatcagagaaagaaacttgcaaatctccactgaagccatgaagatgaaatcctggattgaaaccgtcaaatacattttgcaatccatggaagatggtgaaatcaccatctccgcttacgacactgcttggatcgccttggttccagctttgaacggttcctctgaacctcaattcccatcctctttacaatggttgatcaacaaccaattgcaagacggttcctggggtgacccattgatgttcttgattagagatcgtatcatcaacactttggcttgtgttttggctttgaagacctggaacattcactctttgggtgttaacaagggtctatctttcttgcaaacttacatccctaaaatgaacgatgaacatgatgctcacactccagttggtttcgaaattgtcttcccagctttgatggaagatgccaagatcatggaattggacttgccatacgacgctgaattcttgcaaaagatttacgatgaaagagatttgaagatgaagagaatcccaatgaaggttttgcacgaattcccatctactttattgcactccttggaaggtttgagagacaaggtcaactgggaagaattattgaagttgcaatccaagaacggttctttcttattctctccagcttctactgcttgtgctttggctcaaacttctgacaccaactgtttgagatacttgaatgaaatcaccaagaaatacgacggtggtgctccaaatgtttacccagtcgacttgttcgaaagattatggaccgtcgatcgtattgaaagattaggtattgctagatactttgaatctgaaatcactgactctttggaatacgtttacagatactggactaaccaaggtatcggttgggctagagattctccagttaaggacgtcgatgacacttccatggctttcagactattacgttcccacggtttcgacgttactgctgaagctttcaaccacttcaagcaagatgaccaattcttctgtttctttggtcaaaccaagcaaaccgtcactggtatgtacaacttgtacagagcttctcaattctccttcccaggtgaatctatcttagaagaagctcgtgtcttcaccaagaacttcttggaagaaaagagagctgaaaagcaattgagagacaaatggatcattgctaaaggtttgaaggaagaagtcgaatacgctttgaagttcccatggtatgcctcccaaccaagaattgacaccagaatgtacatcaaccaatacagagttgatgacgtctggatcggtaaggctctatacagaatgccaattgtcaacaacaagacctacatcgaattggccaaggctgacttcaacatttgtcaatctatccacagaactgaattgcacggtatcatcagatggtacagagaatccggtttggacgaattgggtttgagacaagaccaaatcgtcaaatcttacttcttggctgccattgctatctacgaaccagacatggcctctgccagattagcttgggctaagtctgctgtcttgatggctgctatcagaatcttcttttccggtgaaaactgttttgcccaccatagaagacaattcttggatgcctttaccagatgggacggtagagccatgagagattctccaaactccgctaagagattattctcttgtttattcagaatggttaacttgttctctgtcgacggtgttgttgctcaaggtagagacatctccggtgacttgagacacagatgggaacactggttggcctctgaagctgaagacttgaccgatgctcaagaccacgaaaagttgggtactgaagctgaaattgttgttttgactgctgctttcttgggtagagaaaccatttctccagatttgatttctcacccagatttctcttctattatgaaggttaccaacactgtttgttctttattgagaagaattgccacctacaaggaagaaggttgtgactccccatctggtactgaagaagatgacagattgaaacgtcgtgctgaagaaggtatgggtcatttggttcgtgccgtttacagacaccaatactctccagttccatctggtgtcaagagattgtgtttggttgttggtaagtccttttactacgctgctcactgtaacaatgaagaagttggtaaccatgtcgaaaccgtcttgttccaaccagtatac

SEQ ID NO: 6 - protein, 761 aa, Picea glauca
MKMSKSVEVQHCAVQFLSSTTDQIEIRERNLQISTEAMKMKSWIETVKYILQSMEDGEITISAYDTAWIALVPALNGSSEPQFPSSLQWLINNQLQDGSWGDPLMFLIRDRIINTLACVLALKTWNIHSLGVNKGLSFLQTYIPKMNDEHDAHTPVGFEIVFPALMEDAKIMELDLPYDAEFLQKIYDERDLKMKRIPMKVLHEFPSTLLHSLEGLRDKVNWEELLKLQSKNGSFLFSPASTACALAQTSDTNCLRYLNEITKKYDGGAPNVYPVDLFERLWTVDRIERLGIARYFESEITDSLEYVYRYWTNQGIGWARDSPVKDVDDTSMAFRLLRSHGFDVTAEAFNHFKQDDQFFCFFGQTKQTVTGMYNLYRASQFSFPGESILEEARVFTKNFLEEKRAEKQLRDKWIIAKGLKEEVEYALKFPWYASQPRIDTRMYINQYRVDDVWIGKALYRMPIVNNKTYIELAKADFNICQSIHRTELHGIIRWYRESGLDELGLRQDQIVKSYFLAAIAIYEPDMASARLAWAKSAVLMAAIRIFFSGENCFAHHRRQFLDAFTRWDGRAMRDSPNSAKRLFSCLFRMVNLFSVDGVVAQGRDISGDLRHRWEHWLASEAEDLTDAQDHEKLGTEAEIVVLTAAFLGRETISPDLISHPDFSSIMKVTNTVCSLLRRIATYKEEGCDSPSGTEEDDRLKRRAEEGMGHLVRAVYRHQYSPVPSGVKRLCLVVGKSFYYAAHCNNEEVGNHVETVLFQPVY

SEQ ID NO: 7 - DNA, 1548 bp, Bradyrhizobium japonicum
  CDS (1)..(1548)
atgaacgctttgtctgaacacatcttatctgaattgagaagattattgtccgaaatgtctgacggtggttccgtcggtccttccgtttacgacaccgcccaagccttgagattccacggtaacgtcactggtagacaagatgcttacgcttggttgattgctcaacaacaagctgacggtggttggggttctgctgatttcccattattcagacatgccccaacctgggctgctctattggctttgcaaagagctgacccattgccaggtgctgctgatgccgtccaaaccgccaccagattcttgcaaagacaaccagacccatacgctcatgccgttccagaagatgctccaatcggtgctgaattgatcttgcctcaattctgtggtgaagctgcttctctattaggtggtgttgccttcccaagacacccagctttgttgccattgagacaagcttgtttggtcaaattgggtgccgttgccatgttgccatctggtcacccattgttgcactcctgggaagcctggggtacttctccaactactgcttgtccagacgatgacggttccatcggtatctctccagctgctactgctgcttggagagcccaagccgttaccagaggttccactccacaagtcggtagagctgatgcttacttgcaaatggcttccagagccaccagatctggtattgaaggtgttttcccaaatgtctggccaatcaacgtctttgaaccatgttggtctttgtacactttgcacttggctggtttgtttgctcatccagctttggctgaagccgtcagagtcattgttgctcaattggatgctagattaggtgtccacggtttaggtccagctttgcacttcgctgctgacgctgatgacaccgccgttgctctatgtgttttgcacttggctggtcgtgacccagctgttgacgctttgagacacttcgaaattggtgaattgttcgtcactttcccaggtgaaagaaacgcttctgtttccaccaacatccacgctttgcacgctttgagattgttgggtaagccagctgctggtgcttctgcttacgttgaagccaacagaaacccacacggtttatgggacaacgaaaagtggcacgtttcctggttatacccaactgctcacgccgttgctgctttggcccaaggtaagcctcaatggagagatgaaagagctttggccgctttgttgcaagctcaaagagatgacggtggttggggtgctggtcgtggttctactttcgaagaaaccgcctacgctttgtttgctttgcatgtcatggacggttctgaagaagctaccggtagaagaagaattgctcaagttgttgccagagctttggaatggatgttggctcgtcacgctgcccacggtttgccacaaactccattatggatcggtaaggaattgtactgtccaaccagagttgtcagagttgctgaattggctggtttatggttggctttgagatggggtcgtcgtgtcttggctgaaggtgctggtgctgcaccc

SEQ ID NO: 8 - protein, 516 aa, Bradyrhizobium japonicum
MNALSEHILSELRRLLSEMSDGGSVGPSVYDTAQALRFHGNVTGRQDAYAWLIAQQQADGGWGSADFPLFRHAPTWAALLALQRADPLPGAADAVQTATRFLQRQPDPYAHAVPEDAPIGAELILPQFCGEAASLLGGVAFPRHPALLPLRQACLVKLGAVAMLPSGHPLLHSWEAWGTSPTTACPDDDGSIGISPAATAAWRAQAVTRGSTPQVGRADAYLQMASRATRSGIEGVFPNVWPINVFEPCWSLYTLHLAGLFAHPALAEAVRVIVAQLDARLGVHGLGPALHFAADADDTAVALCVLHLAGRDPAVDALRHFEIGELFVTFPGERNASVSTNIHALHALRLLGKPAAGASAYVEANRNPHGLWDNEKWHVSWLYPTAHAVAALAQGKPQWRDERALAALLQAQRDDGGWGAGRGSTFEETAYALFALHVMDGSEEATGRRRIAQVVARALEWMLARHAAHGLPQTPLWIGKELYCPTRVVRVAELAGLWLALRWGRRVLAEGAGAAP

SEQ ID NO: 9 - DNA, 2364 bp, Lactuca sativa
  CDS (1)..(2364)
atgaacattgctcaaatcacctcttctgctatgttggttccatcttctcacatcccacaccgttcctgggttgtcaactgttgtatggttcaatacaacccatccggtctaagaactgcttcctctcaagccggtcaagtcaacccaactgttatgactttggatgtcactaaggaaagaatcagaaagttgttcaacaacgtcgaagtttctgtttcctcttacgacaccgcttgggttgccatggttccatctccaaactctccaaagtccccatgtttcccagactgtttgaactggttgttggacaaccaattggatgatggttcctggggtttgttgccacaccaatctccattgatcaaagacactttatcttctactttggcttgtgttttggctttaaagagatggaacgtcggtaaggatcaaatcaacaagggtttacattacatcgaatccaactttgcttccgtcactgataagaaccaagcctctccattcggttttgacatcattttcccaggtatgttggaatacgccaaggatttggacattaaattgcctttgaaccaaactcacttgtccgtcatgttgcacgaaagagaattggaattgagaagatgtcactctaacggtcgtgaagcctacttagcttacatttccgaaggtttgggtaacttgaacgactggaacatggttatgaagtaccaaatgaagaacggttctttgttcaactctccttctgctactgcttctgttttgattcaccaccaaaatgctggttgtttgcactacttaacctccctattggacaagtttggtaatgctgtcccaactgtttacccaatcgacttgtacgttagattgtccatggttgacactttggaaagattgggtatcaagagacatttcatggttgaaattcaaaatgtcttggacgaaacctacagatgttgggttcaaggtgatgttcaaatcttcatggatgtcgttacctgtgctttggctttcagagttctacgttctaacggttacgaagtctcttctgacccattggctaagattaccaaagaaggtgactacatgaactctccagaaaagcctttcaaggacgtctacacctctttggaagtctacaaggcttctcaaatcatctaccaagaagaattggccttcagagaacaaaacttgacctcttatttgccatcttctaacaaattgtccaactacattttgaaggaagttgatgacgctttgaagttcccattcaatggttctctagaaagaatgtccactagaagaaacattgaacactacaacttgaaccacaccagaattttgaagaccacctactcctcttccaacatttccaacaaggactacttgaaattagccgtccaagacttcaacgaatgtcaatccatctactgtgaagaattaaaggacttggaaagatgggttgtcgaaaacagattagacaagttgaaatttgctcgtcaaaagaccgcttactgttacttctctgctgcttctttcttatcttctccagatttgtccgatgctagaatctcctgggctaaatcttccattttgactaccgtcattgatgatttctttgacgtcggtggttccatggatgaattggttaacttcgtccacatcatcgaaaagtggaacgtcaacgttgaaaacgattgttgttctgaagaagtcggtgttttgttcttggctttaaaggatgctgtctgttggattggtgacaaggctttcaagatccaagaaagaaacatcacttcccacgtcattgaaatctggttggacttggttaagtccatgttgagagaagctatttgggctaaggacggttccatcccaaccatcaacgaatacatggaaaacggttacgtttctttcgccttgggtccaatcgttttgccaactttgtacttcttaggtgtcaagttgtctgaagaagtcgtccaatcttccgaataccacaagttgtacgaagttatgtccacccaaggtagattgatgaacgacattcactctttcaaacgtgaaaagaaggccggtaagttgaatgctgttgctttatacatgtccgacggtaaatctggttctgttgaagaagaagttgtcgaagaaatgaagatcttgactaaatctcaaagaaaggaaatgatgaagttggttttggaaaccaagggttccgttgtcccaagagtttgtaaggacgttttctggaacatgtgtaacgtcttgaacttgttctacgctaccgatgacggtttcactggtaacgccatcttagatgttgtcaaggaaatcatctacgaaccagtctctcatgaattgata

SEQ ID NO: 10 - protein, 788 aa, Lactuca sativa
MNIAQITSSAMLVPSSHIPHRSWVVNCCMVQYNPSGLRTASSQAGQVNPTVMTLDVTKERIRKLFNNVEVSVSSYDTAWVAMVPSPNSPKSPCFPDCLNWLLDNQLDDGSWGLLPHQSPLIKDTLSSTLACVLALKRWNVGKDQINKGLHYIESNFASVTDKNQASPFGFDIIFPGMLEYAKDLDIKLPLNQTHLSVMLHERELELRRCHSNGREAYLAYISEGLGNLNDWNMVMKYQMKNGSLFNSPSATASVLIHHQNAGCLHYLTSLLDKFGNAVPTVYPIDLYVRLSMVDTLERLGIKRHFMVEIQNVLDETYRCWVQGDVQIFMDVVTCALAFRVLRSNGYEVSSDPLAKITKEGDYMNSPEKPFKDVYTSLEVYKASQIIYQEELAFREQNLTSYLPSSNKLSNYILKEVDDALKFPFNGSLERMSTRRNIEHYNLNHTRILKTTYSSSNISNKDYLKLAVQDFNECQSIYCEELKDLERWVVENRLDKLKFARQKTAYCYFSAASFLSSPDLSDARISWAKSSILTTVIDDFFDVGGSMDELVNFVHIIEKWNVNVENDCCSEEVGVLFLALKDAVCWIGDKAFKIQERNITSHVIEIWLDLVKSMLREAIWAKDGSIPTINEYMENGYVSFALGPIVLPTLYFLGVKLSEEVVQSSEYHKLYEVMSTQGRLMNDIHSFKREKKAGKLNAVALYMSDGKSGSVEEEVVEEMKILTKSQRKEMMKLVLETKGSVVPRVCKDVFWNMCNVLNLFYATDDGFTGNAILDVVKEIIYEPVSHELI

SEQ ID NO: 11 - DNA, 2250 bp, Lactuca sativa
  CDS (1)..(2250)
atggcttcctctcaagccggtcaagtcaacccaactgttatgactttggatgtcactaaggaaagaatcagaaagttgttcaacaacgtcgaagtttctgtttcctcttacgacaccgcttgggttgccatggttccatctccaaactctccaaagtccccatgtttcccagactgtttgaactggttgttggacaaccaattggatgatggttcctggggtttgttgccacaccaatctccattgatcaaagacactttatcttctactttggcttgtgttttggctttaaagagatggaacgtcggtaaggatcaaatcaacaagggtttacattacatcgaatccaactttgcttccgtcactgataagaaccaagcctctccattcggttttgacatcattttcccaggtatgttggaatacgccaaggatttggacattaaattgcctttgaaccaaactcacttgtccgtcatgttgcacgaaagagaattggaattgagaagatgtcactctaacggtcgtgaagcctacttagcttacatttccgaaggtttgggtaacttgaacgactggaacatggttatgaagtaccaaatgaagaacggttctttgttcaactctccttctgctactgcttctgttttgattcaccaccaaaatgctggttgtttgcactacttaacctccctattggacaagtttggtaatgctgtcccaactgtttacccaatcgacttgtacgttagattgtccatggttgacactttggaaagattgggtatcaagagacatttcatggttgaaattcaaaatgtcttggacgaaacctacagatgttgggttcaaggtgatgttcaaatcttcatggatgtcgttacctgtgctttggctttcagagttctacgttctaacggttacgaagtctcttctgacccattggctaagattaccaaagaaggtgactacatgaactctccagaaaagcctttcaaggacgtctacacctctttggaagtctacaaggcttctcaaatcatctaccaagaagaattggccttcagagaacaaaacttgacctcttatttgccatcttctaacaaattgtccaactacattttgaaggaagttgatgacgctttgaagttcccattcaatggttctctagaaagaatgtccactagaagaaacattgaacactacaacttgaaccacaccagaattttgaagaccacctactcctcttccaacatttccaacaaggactacttgaaattagccgtccaagacttcaacgaatgtcaatccatctactgtgaagaattaaaggacttggaaagatgggttgtcgaaaacagattagacaagttgaaatttgctcgtcaaaagaccgcttactgttacttctctgctgcttctttcttatcttctccagatttgtccgatgctagaatctcctgggctaaatcttccattttgactaccgtcattgatgatttctttgacgtcggtggttccatggatgaattggttaacttcgtccacatcatcgaaaagtggaacgtcaacgttgaaaacgattgttgttctgaagaagtcggtgttttgttcttggctttaaaggatgctgtctgttggattggtgacaaggctttcaagatccaagaaagaaacatcacttcccacgtcattgaaatctggttggacttggttaagtccatgttgagagaagctatttgggctaaggacggttccatcccaaccatcaacgaatacatggaaaacggttacgtttctttcgccttgggtccaatcgttttgccaactttgtacttcttaggtgtcaagttgtctgaagaagtcgtccaatcttccgaataccacaagttgtacgaagttatgtccacccaaggtagattgatgaacgacattcactctttcaaacgtgaaaagaaggccggtaagttgaatgctgttgctttatacatgtccgacggtaaatctggttctgttgaagaagaagttgtcgaagaaatgaagatcttgactaaatctcaaagaaaggaaatgatgaagttggttttggaaaccaagggttccgttgtcccaagagtttgtaaggacgttttctggaacatgtgtaacgtcttgaacttgttctacgctaccgatgacggtttcactggtaacgccatcttagatgttgtcaaggaaatcatctacgaaccagtctctcatgaattgata

SEQ ID NO: 12 - protein, 750 aa, Lactuca sativa
MASSQAGQVNPTVMTLDVTKERIRKLFNNVEVSVSSYDTAWVAMVPSPNSPKSPCFPDCLNWLLDNQLDDGSWGLLPHQSPLIKDTLSSTLACVLALKRWNVGKDQINKGLHYIESNFASVTDKNQASPFGFDIIFPGMLEYAKDLDIKLPLNQTHLSVMLHERELELRRCHSNGREAYLAYISEGLGNLNDWNMVMKYQMKNGSLFNSPSATASVLIHHQNAGCLHYLTSLLDKFGNAVPTVYPIDLYVRLSMVDTLERLGIKRHFMVEIQNVLDETYRCWVQGDVQIFMDVVTCALAFRVLRSNGYEVSSDPLAKITKEGDYMNSPEKPFKDVYTSLEVYKASQIIYQEELAFREQNLTSYLPSSNKLSNYILKEVDDALKFPFNGSLERMSTRRNIEHYNLNHTRILKTTYSSSNISNKDYLKLAVQDFNECQSIYCEELKDLERWVVENRLDKLKFARQKTAYCYFSAASFLSSPDLSDARISWAKSSILTTVIDDFFDVGGSMDELVNFVHIIEKWNVNVENDCCSEEVGVLFLALKDAVCWIGDKAFKIQERNITSHVIEIWLDLVKSMLREAIWAKDGSIPTINEYMENGYVSFALGPIVLPTLYFLGVKLSEEVVQSSEYHKLYEVMSTQGRLMNDIHSFKREKKAGKLNAVALYMSDGKSGSVEEEVVEEMKILTKSQRKEMMKLVLETKGSVVPRVCKDVFWNMCNVLNLFYATDDGFTGNAILDVVKEIIYEPVSHELI

SEQ ID NO: 13 - DNA, 2271 bp, Picea glauca
  CDS (1)..(2271)
atgaagagagaacaatacactatcttgaacgaaaaggaatccatggctgaagaattaatcttgagaatcaagagaatgttttctgaaatcgaaaacactcaaacctctgcttctgcttacgacaccgcttgggttgccatggttccatctttggactcctctcaacaaccacaattccctcaatgtttgtcctggatcattgacaaccaattgttggatggttcctggggtatcccatacttgatcatcaaggacagactatgtcacactttagcttgtgtcattgctttgagaaaatggaacgctggtaaccaaaatgtcgaaaccggtctacgtttcttgagagaaaacattgaaggtatcgttcacgaagatgaatacactccaattggtttccaaatcattttcccagctatgttggaagaagctcgtggtttaggtctagaattgccatacgacttgactccaatcaagttgatgttgacccacagagaaaagatcatgaagggtaaggccattgaccacatgcacgaatacgactcttctttgatctacactgttgaaggtatccacaagatcgttgactggaacaaggttttgaaacatcaaaacaaggatggttctttgttcaactctccatctgctactgcttgtgctttgatgcacactagaaagtccaactgtttggaatacttgtcctccatgttgcaaaagttaggtaacggtgttccatccgtctacccaatcaacttatatgctcgtatctccatgattgacagattacaaagattaggtttggctagacatttcagaaacgaaatcattcacgctttggacgacatctacagatactggatgcaaaaggaaacctccagagaaggtaagtctttgaccccagatattgtctctacttccatcgctttcatgttgttgagattgcacggttacgatgttccagctgatgttttctgttgttaccatttgcactccattgaacaatctggtgaagccgttactgctatgttgtctttgtacagagcctctcaaattatgttcccaggtgaaaccattttggaagaaatcaagaccgtttctagaaagtacttggacaagagaaaggaaaacggtcgtatctactaccacaacattgttatgaaggacttgagaggtgaagtcgaatacgccttgtctgttccatggtacgcttccttggaaagaattgaaaacagaagatacattgaccaatacggtgtcaacgatacctggatcgctaagacctcttacaaaatcccatgtatctccaatgacttattcttggctttggccaagcaagactacaacatctgtcaagccattcaacaaaaggaattgagagaattggaaagatggtttgctgataacaaattctctcacttgaacttcgctcgtcaaaagttgatctactgttacttctctgccgctgctactttgttctctccagaattgtctgctgccagagttgtctgggctaagaacggtgttatcaccaccgtcgttgatgacttcttcgatgtcggtggttcttctgaagaaattcactctttcgtcgaagctgttagagtctgggacgaagctgctaccgatggtttgtctgaaaacgttcaaatcttattctccgctttatacaacaccgtcgacgaaattgtccaacaagccttcgttttccaaggtagagacatctccattcacttgagagaaatctggtacagattggtcaactccatgatgactgaagctcaatgggctagaactcactgtattccatccatgcacgaatacatggaaaacgctgaaccttctattgctttggaaccaatcgtcttgtcctctttatactttgttggtccaaagttgtctgaagaaatcatttgtcacccagaatactacaacttgatgcatttgttgaatatctgtggtagattgttgaacgatatccaaggttgtaaacgtgaagcccaccaaggtaagttgaactccgtcactttgtacatggaagaaaactctggtactaccatggaagatgctatcgtttacttgagaaagaccatcgacgaatccagacaattgctattgaaagaagttttaagaccatctattgttccaagagaatgtaaacaattgcactggaacatgatgagaatcttgcaattgttctacttgaagaacgatggttttacctctccaactgaaatgttgggttacgtcaacgccgtcattgtcgacccaattttg

SEQ ID NO: 14 - protein, 757 aa, Picea glauca
MKREQYTILNEKESMAEELILRIKRMFSEIENTQTSASAYDTAWVAMVPSLDSSQQPQFPQCLSWIIDNQLLDGSWGIPYLIIKDRLCHTLACVIALRKWNAGNQNVETGLRFLRENIEGIVHEDEYTPIGFQIIFPAMLEEARGLGLELPYDLTPIKLMLTHREKIMKGKAIDHMHEYDSSLIYTVEGIHKIVDWNKVLKHQNKDGSLFNSPSATACALMHTRKSNCLEYLSSMLQKLGNGVPSVYPINLYARISMIDRLQRLGLARHFRNEIIHALDDIYRYWMQKETSREGKSLTPDIVSTSIAFMLLRLHGYDVPADVFCCYHLHSIEQSGEAVTAMLSLYRASQIMFPGETILEEIKTVSRKYLDKRKENGRIYYHNIVMKDLRGEVEYALSVPWYASLERIENRRYIDQYGVNDTWIAKTSYKIPCISNDLFLALAKQDYNICQAIQQKELRELERWFADNKFSHLNFARQKLIYCYFSAAATLFSPELSAARVVWAKNGVITTVVDDFFDVGGSSEEIHSFVEAVRVWDEAATDGLSENVQILFSALYNTVDEIVQQAFVFQGRDISIHLREIWYRLVNSMMTEAQWARTHCIPSMHEYMENAEPSIALEPIVLSSLYFVGPKLSEEIICHPEYYNLMHLLNICGRLLNDIQGCKREAHQGKLNSVTLYMEENSGTTMEDAIVYLRKTIDESRQLLLKEVLRPSIVPRECKQLHWNMMRILQLFYLKNDGFTSPTEMLGYVNAVIVDPIL

SEQ ID NO: 15 - DNA, 900 bp, Bradyrhizobium japonicum
  CDS (1)..(900)
atgatccaaactgaaagagctgtccaacaagttttggaatggggtcgttctttgaccggtttcgctgacgaacacgctgtcgaagctgttcgtggtggtcaatacatcttacaaagaatccacccatctttgagaggtacttctgccagaactggtagagatccacaagatgaaactttgattgtcaccttttacagagaattggctttgttgttctggttagatgactgtaacgatttgggtttgatttccccagaacaattggctgctgtcgaacaagctttgggtcaaggtgtcccatgtgctttgccaggtttcgaaggttgtgccgttttgagagcttctttggccactttggcctacgacagaagagactacgctcaattgttggatgacaccagatgttactccgctgctttgagagctggtcatgcccaagctgttgctgctgaaagatggtcctacgctgaatacttgcacaacggtattgactccattgcttacgctaacgttttctgttgtttgtccctattatggggtttggacatggctactttgagagccagaccagctttcagacaagtcttgagattaatctctgccattggtagattacaaaacgatttgcacggttgtgacaaggaccgttctgctggtgaagctgacaacgctgtcatcttattgttgcaaagatacccagccatgccagttgttgaattcttgaacgatgaattggctggtcacaccagaatgttgcaccgtgtcatggctgaagaaagattcccagctccatggggtccattaatcgaagctatggctgccatcagagttcaatactacagaacctccacctctcgttacagatctgacgctgttagaggtggtcaaagagcccctgcc

SEQ ID NO: 16 - protein, 300 aa, Bradyrhizobium japonicum
MIQTERAVQQVLEWGRSLTGFADEHAVEAVRGGQYILQRIHPSLRGTSARTGRDPQDETLIVTFYRELALLFWLDDCNDLGLISPEQLAAVEQALGQGVPCALPGFEGCAVLRASLATLAYDRRDYAQLLDDTRCYSAALRAGHAQAVAAERWSYAEYLHNGIDSIAYANVFCCLSLLWGLDMATLRARPAFRQVLRLISAIGRLQNDLHGCDKDRSAGEADNAVILLLQRYPAMPVVEFLNDELAGHTRMLHRVMAEERFPAPWGPLIEAMAAIRVQYYRTSTSRYRSDAVRGGQRAPA

SEQ ID NO: 17 - DNA, 2838 bp, Phaeosphaeria sp.
  CDS (1)..(2838)
atgtttgctaagtttgatatgttggaagaagaagctagagctttggtcagaaaggtcggtaacgctgttgacccaatctacggtttctctaccacttcctgtcaaatctacgacaccgcttgggctgctatgatctccaaggaagaacacggtgacaaggtctggttgttcccagaatctttcaaatacttgttggaaaagcaaggtgaagatggttcctgggaaagacatccaagatccaagactgtcggtgttttgaacactgctgccgcttgtttggccttgttgagacacgtcaagaaccctttgcaattgcaagacattgctgcccaagacatcgaattgagaatccaaagaggtttgcgttctttggaagaacaattgattgcttgggatgatgtcttggacaccaaccacatcggtgtcgaaatgattgttccagctttgttggactacttgcaagccgaagatgaaaacgttgactttgaattcgaatcccactctctattgatgcaaatgtacaaagaaaagatggccagattctccccagaatccttatacagagctagaccatcttctgccttacataatttggaagctttgatcggtaaattggactttgacaaggttggtcaccacttgtacaacggttccatgatggcttccccatcttccactgctgcctttctaatgcatgcctctccatggtcccacgaagctgaagcttacctacgtcacgttttcgaagctggtactggtaagggttccggtggtttcccaggtacttacccaaccacttacttcgaattgaactgggttttgtccactttgatgaaatctggtttcactttatctgatttggaatgtgatgaattatcttccattgccaacaccattgctgaaggtttcgaatgtgaccacggtgtcatcggttttgctccaagagctgtcgatgtcgacgacaccgctaagggtttgttgactttaactttattaggtatggatgaaggtgtttctccagctccaatgattgctatgttcgaagccaaggaccacttcttgactttcttgggtgaacgtgacccatctttcacttctaactgtcacgttttgttatctttgttgcacagaaccgatttgttgcaatatttgcctcaaatcagaaagaccaccaccttcttgtgtgaagcctggtgggcttgtgacggtcaaatcaaggacaaatggcacttatctcacttgtacccaaccatgttgatggtccaagctttcgctgaaatcttattgaagtctgctgaaggtgaaccattgcacgatgctttcgatgccgctactttgtccagagtctccatttgtgttttccaagcttgtttgagaactctattggcccaatctcaagatggttcttggcacggtcaaccagaagcttcttgttacgctgtcttgactttggctgaatctggtcgtttggttttgttgcaagctttgcaaccacaaatcgctgctgccatggaaaaggccgctgatgttatgcaagctggtagatggtcctgttctgatcatgactgtgactggacctccaagaccgcttacagagttgacttagttgctgctgcttacagattagctgctatgaaagcttcttccaacttgactttcaccgtcgatgacaacgtttccaagagatccaacggtttccaacaattggtcggtagaactgacttgttctctggtgtcccagcctgggaattacaagcttctttcttggaatctgctttgttcgttcctttgttgagaaaccatagattggatgttttcgacagagatgacatcaaggtttctaaggaccactacttggacatgatcccattcacctgggttggttgtaacaacagatctagaacctacgtttctacctctttcttgttcgacatgatgatcatctccatgttgggttaccaaatcgatgaattcttcgaagctgaagctgctccagctttcgctcaatgtattggtcaattgcaccaagtcgtcgacaaggttgttgatgaagtcattgacgaagtcgtcgataaggttgtcggtaaggtcgttggtaaggttgttggtaaggttgtcgacgaacgtgttgactctccaacccacgaagccattgccatctgtaacatcgaagcttctttaagaagattcgtcgatcacgttttgcaccaccaacatgtcttacacgcttctcaacaagaacaagacattttgtggagagaattgagagccttcttgcacgctcacgttgtccaaatggccgacaactccactttggctccaccaggtagaactttcttcgactgggttagaaccactgctgctgaccacgttgcctgtgcttactctttcgctttcgcttgttgtatcacctctgctactatcggtcaaggtcaatctatgttcgctaccgtcaacgaattgtacttggtccaagctgctgctcgtcacatgaccaccatgtgtagaatgtgtaacgacattggttccgtcgacagagatttcatcgaagctaacattaactccgttcacttcccagaattctccactttgtctttggttgctgacaagaagaaagctttggccagattggctgcctacgaaaagtcttgtttgactcacactttggaccaatttgaaaatgaagttttacaatctccacgtgtttcttctgctgcctccggtgatttcagaaccagaaaggttgccgttgttagattctttgctgatgtcactgacttctacgatcaattgtacattttgagagatttgtcctcttctttgaagcatgtcggaacc

SEQ ID NO: 18 - protein, 946 aa, Phaeosphaeria sp.
MFAKFDMLEEEARALVRKVGNAVDPIYGFSTTSCQIYDTAWAAMISKEEHGDKVWLFPESFKYLLEKQGEDGSWERHPRSKTVGVLNTAAACLALLRHVKNPLQLQDIAAQDIELRIQRGLRSLEEQLIAWDDVLDTNHIGVEMIVPALLDYLQAEDENVDFEFESHSLLMQMYKEKMARFSPESLYRARPSSALHNLEALIGKLDFDKVGHHLYNGSMMASPSSTAAFLMHASPWSHEAEAYLRHVFEAGTGKGSGGFPGTYPTTYFELNWVLSTLMKSGFTLSDLECDELSSIANTIAEGFECDHGVIGFAPRAVDVDDTAKGLLTLTLLGMDEGVSPAPMIAMFEAKDHFLTFLGERDPSFTSNCHVLLSLLHRTDLLQYLPQIRKTTTFLCEAWWACDGQIKDKWHLSHLYPTMLMVQAFAEILLKSAEGEPLHDAFDAATLSRVSICVFQACLRTLLAQSQDGSWHGQPEASCYAVLTLAESGRLVLLQALQPQIAAAMEKAADVMQAGRWSCSDHDCDWTSKTAYRVDLVAAAYRLAAMKASSNLTFTVDDNVSKRSNGFQQLVGRTDLFSGVPAWELQASFLESALFVPLLRNHRLDVFDRDDIKVSKDHYLDMIPFTWVGCNNRSRTYVSTSFLFDMMIISMLGYQIDEFFEAEAAPAFAQCIGQLHQVVDKVVDEVIDEVVDKVVGKVVGKVVGKVVDERVDSPTHEAIAICNIEASLRRFVDHVLHHQHVLHASQQEQDILWRELRAFLHAHVVQMADNSTLAPPGRTFFDWVRTTAADHVACAYSFAFACCITSATIGQGQSMFATVNELYLVQAAARHMTTMCRMCNDIGSVDRDFIEANINSVHFPEFSTLSLVADKKKALARLAAYEKSCLTHTLDQFENEVLQSPRVSSAASGDFRTRKVAVVRFFADVTDFYDQLYILRDLSSSLKHVGT

SEQ ID NO: 19 - DNA, 2856 bp, Gibberella fujikuroi
  CDS (1)..(2856)
atgccaggtaagatcgaaaacggtactccaaaggatttaaagactggtaacgatttcgtttctgctgccaagtctttgttggacagagctttcaaatctcaccactcttactacggtttatgttccacttcttgtcaagtttacgacactgcttgggttgccatgatcccaaagaccagagataatgtcaaacaatggttgttccctgaatgtttccactacttgttgaaaacccaagctgctgatggttcctggggttctttgccaaccactcaaaccgctggtatcttggataccgcttccgctgtcttggctttgctatgtcacgctcaagaaccattgcaaatcttggatgtttctccagatgaaatgggtttgagaatcgaacacggtgttacttctttgaagagacaattggctgtctggaacgacgtcgaggacactaaccacattggtgtcgaatttattattccagctttattgtccatgttggaaaaggaattggatgttccatctttcgaattcccatgtagatccatcttggaaagaatgcacggtgaaaagttgggtcacttcgatttggaacaagtctacggtaagccatcttctttactacattctttggaagctttcttaggtaagttagacttcgacagattgtcccaccacttgtaccacggttccatgatggcttctccatcctccactgctgcctacttgattggtgctaccaaatgggatgacgaagctgaggactacttgagacacgttatgagaaacggtgctggtcatggtaacggtggtatctccggtactttcccaaccacccatttcgaatgttcctggatcattgccactttgttgaaggttggtttcaccttgaaacaaattgacggtgacggtttgagaggtctatccactatcttattggaagctttacgtgacgaaaacggtgtcatcggtttcgctccaagaaccgctgatgtcgacgacaccgccaaggctttgttggctttgtctttagttaaccaacctgtctctccagatatcatgattaaggttttcgaaggtaaggaccattttaccactttcggttctgaacgtgatccatctttgacctctaacttgcacgtcttgttgtctttgttgaagcaatctaacttgtctcaataccatccacaaatcttaaagactactttgtttacctgtagatggtggtggggttctgaccattgtgtcaaggacaagtggaacttgtctcatttgtacccaaccatgttgttggtcgaagccttcactgaagtcttgcacttgattgacggtggtgaattgtcctctttgttcgatgaatctttcaaatgtaagatcggtttgtccattttccaagctgttttgagaatcatcttgactcaagacaacgatggttcctggagaggttacagagaacaaacctgttacgccattttggctttggtccaagctcgtcacgtttgtttcttcactcacatggtcgatagattacaatcttgtgtcgacagaggtttctcctggttaaagtcttgttccttccactctcaagacttgacttggacctccaagactgcttacgaagttggtttcgttgctgaagcctacaaattggctgctttgcaatctgcttctttggaagttccagctgctaccatcggtcactccgttacctctgctgtcccatcttctgacttggaaaagtacatgagattggtccgtaagactgctttgttctctccattggacgaatggggtttgatggcttccattattgaatcttctttctttgtcccattgttgcaagctcaaagagtcgaaatctacccaagagataatatcaaggttgacgaggacaagtacttgtccatcattccatttacctgggttggttgtaataacagatctagaactttcgcttctaacagatggttatatgacatgatgtacttatctttgttgggttaccaaactgacgaatacatggaagctgttgccggtccagttttcggtgatgtttctctattgcaccaaaccatcgacaaggttatcgacaacaccatgggtaacttggccagagccaacggtactgttcactctggtaacggtcaccaacacgaatctccaaacattggtcaagttgaggacactttgaccagattcaccaactccgttttgaaccacaaggacgtcttgaactcttcttcttctgaccaagataccttacgtcgtgaattcagaactttcatgcacgctcacatcacccaaatcgaagataactccagattctccaagcaagcctcctctgatgccttttcttctccagaacaatcttacttccaatgggttaactccactggtggttctcacgttgcttgtgcctactccttcgccttttccaactgtttgatgtccgctaacttattgcaaggtaaggatgctttcccatctggtactcaaaagtacttgatctcctccgtcatgagacacgctaccaacatgtgtcgtatgtacaacgatttcggttctattgccagagacaacgctgaaagaaacgttaactccattcacttccctgaattcactctatgtaacggtacttctcaaaacttggatgaaagaaaggaaagattattgaagatcgctacctacgaacaaggttacttggacagagctttggaagctttggaaagacaatccagagatgacgctggtgacagagctggttccaaggacatgagaaaattgaagattgtcaaattgttctgtgatgttaccgacttgtacgaccaattgtacgtcatcaaggacttgtcctcttccatgaag

SEQ ID NO: 20 - protein, 952 aa, Gibberella fujikuroi
MPGKIENGTPKDLKTGNDFVSAAKSLLDRAFKSHHSYYGLCSTSCQVYDTAWVAMIPKTRDNVKQWLFPECFHYLLKTQAADGSWGSLPTTQTAGILDTASAVLALLCHAQEPLQILDVSPDEMGLRIEHGVTSLKRQLAVWNDVEDTNHIGVEFIIPALLSMLEKELDVPSFEFPCRSILERMHGEKLGHFDLEQVYGKPSSLLHSLEAFLGKLDFDRLSHHLYHGSMMASPSSTAAYLIGATKWDDEAEDYLRHVMRNGAGHGNGGISGTFPTTHFECSWIIATLLKVGFTLKQIDGDGLRGLSTILLEALRDENGVIGFAPRTADVDDTAKALLALSLVNQPVSPDIMIKVFEGKDHFTTFGSERDPSLTSNLHVLLSLLKQSNLSQYHPQILKTTLFTCRWWWGSDHCVKDKWNLSHLYPTMLLVEAFTEVLHLIDGGELSSLFDESFKCKIGLSIFQAVLRIILTQDNDGSWRGYREQTCYAILALVQARHVCFFTHMVDRLQSCVDRGFSWLKSCSFHSQDLTWTSKTAYEVGFVAEAYKLAALQSASLEVPAATIGHSVTSAVPSSDLEKYMRLVRKTALFSPLDEWGLMASIIESSFFVPLLQAQRVEIYPRDNIKVDEDKYLSIIPFTWVGCNNRSRTFASNRWLYDMMYLSLLGYQTDEYMEAVAGPVFGDVSLLHQTIDKVIDNTMGNLARANGTVHSGNGHQHESPNIGQVEDTLTRFTNSVLNHKDVLNSSSSDQDTLRREFRTFMHAHITQIEDNSRFSKQASSDAFSSPEQSYFQWVNSTGGSHVACAYSFAFSNCLMSANLLQGKDAFPSGTQKYLISSVMRHATNMCRMYNDFGSIARDNAERNVNSIHFPEFTLCNGTSQNLDERKERLLKIATYEQGYLDRALEALERQSRDDAGDRAGSKDMRKLKIVKLFCDVTDLYDQLYVIKDLSSSMK

SEQ ID NO: 21 - DNA, 1533 bp, Lactuca sativa
  CDS (1)..(1533)
atggacttgcaaaccatggccccaatgggttctgctgctatcgccatcggtggtccagctgtcgccgttgctggtggtatctccttgttgttcttgaaatccttcttgtctcaacaaccaggtaacccaaaccacttgccatctgtcccagctgtcccaggtgttcctctattaggtaacttgttggaattgaaggaaaagaagccatacaagacctttaccaaatgggctgaaacttacggtccaatctactccatcaagaccggtgctacctccatggttgtcgttaactccaaccaattggccaaggaagctatggtcaccagattcgactccatctctaccagaaagttgtccaaggctttgcaaattttgactgctgacaagaccatggttgccatgtctgactacgatgactaccataaaactgtcaagagaaacttgttgacttctattttgggtccagctgctcaaaagagacacagagcccaccgtgacgctatgggtgacaacttgtccagacaattgcacgctttagctttgaactctcctcaagaagccattaacttcagacaaatcttccaatctgaattattcactttagctttcaagcaaactttcggtagagatatcgaatctatcttcgtcggtgatttgggtactaccatgaccagagaagaaatgttccaaattttggttgttgacccaatgatgggtgctattgacgttgactggagagacttcttcccatacttgaaatggattccaaacgccaaattggaagaaaagatcgaacaaatgtacatcagaagaaaggctgttatgaaggctgttatccaagaacacagaaagagaattgattctggtgaaaacttggattcttacattgatttcttgttggctgaagctcaaccattgactgaaaagcaattattgatgtccttgtgggaaccaattattgaaacttctgacaccaccatggttaccactgaatgggctatgtacgaattgtctaagcacccaaacaagcaacaaagattatacaatgaaatcagaaacatctgtggttctgaaaagatcactgaagaaaagttgtgtaagatgccatacttatctgctgtctttcacgaaactttacgtgttcactctccagtttccatcattccattacgttacgttcacgaaaacactgaattgggtggttaccatgtcccagctggtactgaattggctgtcaacatctacggttgtaacatggaaagagaaatctgggaaaacccagaagaatggtccccagaaagattcttggctgaaaacgaaccagttaacttgcaaaagaccatggcctttggtgctggtaagagagtctgtgccggtgctatgcaagctatgttgttggcttgtgtcggtattggtagaatggttcaagaattcgaatggagattgaaagatgacgtcgaagaagatgtcaacactttaggtttgaccactcaaagattgaacccaatgttggctgttatcaagcctaggaat

SEQ ID NO: 22 - protein, 511 aa, Lactuca sativa
MDLQTMAPMGSAAIAIGGPAVAVAGGISLLFLKSFLSQQPGNPNHLPSVPAVPGVPLLGNLLELKEKKPYKTFTKWAETYGPIYSIKTGATSMVVVNSNQLAKEAMVTRFDSISTRKLSKALQILTADKTMVAMSDYDDYHKTVKRNLLTSILGPAAQKRHRAHRDAMGDNLSRQLHALALNSPQEAINFRQIFQSELFTLAFKQTFGRDIESIFVGDLGTTMTREEMFQILVVDPMMGAIDVDWRDFFPYLKWIPNAKLEEKIEQMYIRRKAVMKAVIQEHRKRIDSGENLDSYIDFLLAEAQPLTEKQLLMSLWEPIIETSDTTMVTTEWAMYELSKHPNKQQRLYNEIRNICGSEKITEEKLCKMPYLSAVFHETLRVHSPVSIIPLRYVHENTELGGYHVPAGTELAVNIYGCNMEREIWENPEEWSPERFLAENEPVNLQKTMAFGAGKRVCAGAMQAMLLACVGIGRMVQEFEWRLKDDVEEDVNTLGLTTQRLNPMLAVIKPRN

SEQ ID NO: 23 - DNA, 1536 bp, Lactuca sativa
  CDS (1)..(1536)
atggatggtgtcattgacatgcaaaccattccattgagaaccgccattgccattggtggtactgctgttgctttggttgttgctctatacttctggttcttgagatcttacgcttctccatctcaccactctaaccatttgccacctgttccagaagttccaggtgtcccagtcttgggtaacttgttgcaattgaaagaaaagaagccatacatgactttcaccaaatgggctgaaatgtacggtccaatctactctatcagaactggtgctacctccatggttgttgtttcctctaacgaaattgccaaggaagttgttgtcactagattcccatccatctccaccagaaagttgtcttacgctttgaaggtcttgactgaagataagtccatggttgctatgtctgattaccatgactaccacaagaccgtcaaaagacacattttgactgctgtcttaggtccaaacgcccaaaagaagttccgtgctcacagagacaccatgatggaaaacgtttccaatgaattgcatgccttctttgaaaagaacccaaaccaagaagtcaacttgagaaagatcttccaatctcaattgttcggtttggccatgaagcaagctttgggtaaggatgtcgaatctatctacgtcaaggacttggaaactaccatgaagagagaagaaatctttgaagtcttggttgttgacccaatgatgggtgccattgaagtcgattggagagacttcttcccatacttgaaatgggttccaaacaaatctttcgaaaacatcattcacagaatgtacacccgtcgtgaagctgtcatgaaggctttgatccaagaacacaagaagagaattgcttctggtgaaaacttaaactcctacattgactacttgttgtctgaagctcaaactttgactgacaagcaattgttgatgtccctatgggaaccaatcattgaatcttccgacaccaccatggtcaccactgaatgggctatgtacgaattggctaagaatccaaacatgcaagacagattgtacgaagaaatccaatctgtttgtggttccgaaaagatcactgaagaaaacttgtctcaattaccatacttgtacgctgttttccaagaaactttgagaaagcactgtccagttccaatcatgccattgagatacgtccacgaaaacaccgttttgggtggttaccacgttccagctggtactgaagttgctatcaacatctatggttgtaacatggacaagaaggtctgggaaaacccagaagaatggaacccagaaagattcttatccgaaaaggaatccatggacttgtacaagaccatggccttcggtggtggtaagagagtttgtgctggttctttgcaagctatggtcatctcttgtatcggtattggtagattagtccaagattttgaatggaaattgaaagatgacgctgaagaagatgtcaacactttaggtttaaccactcaaaagttgcacccattattggctttgatcaaccctcgaaag

SEQ ID NO: 24 - protein, 512 aa, Lactuca sativa
MDGVIDMQTIPLRTAIAIGGTAVALVVALYFWFLRSYASPSHHSNHLPPVPEVPGVPVLGNLLQLKEKKPYMTFTKWAEMYGPIYSIRTGATSMVVVSSNEIAKEVVVTRFPSISTRKLSYALKVLTEDKSMVAMSDYHDYHKTVKRHILTAVLGPNAQKKFRAHRDTMMENVSNELHAFFEKNPNQEVNLRKIFQSQLFGLAMKQALGKDVESIYVKDLETTMKREEIFEVLVVDPMMGAIEVDWRDFFPYLKWVPNKSFENIIHRMYTRREAVMKALIQEHKKRIASGENLNSYIDYLLSEAQTLTDKQLLMSLWEPIIESSDTTMVTTEWAMYELAKNPNMQDRLYEEIQSVCGSEKITEENLSQLPYLYAVFQETLRKHCPVPIMPLRYVHENTVLGGYHVPAGTEVAINIYGCNMDKKVWENPEEWNPERFLSEKESMDLYKTMAFGGGKRVCAGSLQAMVISCIGIGRLVQDFEWKLKDDAEEDVNTLGLTTQKLHPLLALINPRK

SEQ ID NO: 25 - DNA, 1575 bp, Sphaceloma manihoticola
  CDS (1)..(1575)
atgatggacgacaccacttctccatactccacttaccactctgtcagatccattagaaaccaatctgcttgggctttggctccaattgctgtctttatttgttacgttgtcttgagacacaacagaaagtctgtcccagctgcctccgctggttctcactccatcttggaaccattatggttagctagattacgtttcatcagagactccagattcatcatcggtcaaggttactccaagttcaaggatactatcttcaaggttaccaaggtcggtgctgacatcatcgttgttgctccaaagtacgtcgaagaaatcagaagattgtctcgtgacaccggtagatctgttgaaccattcatccacgatttcgctggtgaattgttgggtggtttgaatttcttggaatctgatttgcaaaccagagttgtccaacaaaagttgaccccaaacttgaaaactattgtcccagtcatggaagatgaaatgcattacgctttggtttctgaattggattcttgtttggacggttccgaacactggaccagagttgacatgattcacatgttgtccagaatcgtttccagaatttctgccagaatcttcttgggtccaaagtactgtagaaacgacttatggttaaagaccaccgctgaatacactgaaaacttgttcttgaccggtactctattgagatttgtcccaagaatgttgcaaaagtggatcgctccattactaccatctttccgtcaattgcaagaaaacagacaagctgccagaaagatcatttctgaaattttgactgaccatcaaccagaaaagcacgatgaaacctctgacaacggtgacccatacccagatatcttgactttgatgttccaagctgcccgtggtaaggaaaaggacatcgaagatatcgctcaacacactttgttgctatctttgtcctccattcacactaccgctttgaccatgactcaagctttgtacgacttgtgtgcctacccacaatacttggaccctgttaagcacgaaattgctgacaccttgcaatctgaaggttcctggtctaaggctatgttggacaaattgcacatgatggactctttgttgagagaatctcaaagattatctcctgttttcttattgactttcaacagaattttgcacaccccattgactttgtccaacggtatccatttgccaaagggtactagaattgctgctccttctgatgccattttgaacgatccatctttagtcccaggtccacaaccagctgacactttcgacccatttagatacatcaaccactccactggtgatgctaagaaaaccaagaccaacttccaaaccacttctttgcaaaacatggctttcggttacggtaaatacgcttgtccaggtcgtttctatgttgccaacgaaatcaaattggttttaggtcacttgttgatgcactacgaattcaagttcccaccaggtatgggtagaccagttaactccaccgtcgatactgacatgtacccagatttgggtgccagattgttggttagaaagagaaagatggaagaa

SEQ ID NO: 26 - protein, 525 aa, Sphaceloma manihoticola
MMDDTTSPYSTYHSVRSIRNQSAWALAPIAVFICYVVLRHNRKSVPAASAGSHSILEPLWLARLRFIRDSRFIIGQGYSKFKDTIFKVTKVGADIIVVAPKYVEEIRRLSRDTGRSVEPFIHDFAGELLGGLNFLESDLQTRVVQQKLTPNLKTIVPVMEDEMHYALVSELDSCLDGSEHWTRVDMIHMLSRIVSRISARIFLGPKYCRNDLWLKTTAEYTENLFLTGTLLRFVPRMLQKWIAPLLPSFRQLQENRQAARKIISEILTDHQPEKHDETSDNGDPYPDILTLMFQAARGKEKDIEDIAQHTLLLSLSSIHTTALTMTQALYDLCAYPQYLDPVKHEIADTLQSEGSWSKAMLDKLHMMDSLLRESQRLSPVFLLTFNRILHTPLTLSNGIHLPKGTRIAAPSDAILNDPSLVPGPQPADTFDPFRYINHSTGDAKKTKTNFQTTSLQNMAFGYGKYACPGRFYVANEIKLVLGHLLMHYEFKFPPGMGRPVNSTVDTDMYPDLGARLLVRKRKMEE

SEQ ID NO: 27 - DNA, 1440 bp, Artemisia annua
  CDS (1)..(1440)
atgccaatgaccgtcatgttgttgttcgttttcttattattcattgccatctgtttcttcttggtccacagacacaactccaccaccaccaagaacttgccaccaggttctttcggttggccattcatcggtgaaactttggcttacatcagatccaagagaggtggtgacccagaaagattcaccaaggaaagaattgaaaagtacggttccactttagtctttaagacctctgttgctggtgaaagaatggctgtcttttgtggtccagaaggtaacaagttcttgtttggtaacgaaaacaaattggttgcttcctggtggccaaactctgttagaattttgttcgaaaagtgtttgattaccatcagaggtgacgaagctaaatggttacgtaaaatgatgttcgcttacttgggtccagacgctctatccaacagatacactggtactatggaagttgttaccagattgcacatccaaaaccactggcaaggtaagtctgaattgaaggtctttgaaaccgttagaccatacttgttcgaattggcctgtagattattcttgtctttggatgacccaaagcacgttgctgaattgggtactttattcaacactttcttgaagggtttgactgaattgccaatcaacattccaggtactagattctacagagccaagagagctgccaacgccatcaagaaacaattgattgtcatcatcaagcaacgtcgtcaagctttgaagcaagaagatcaatcttcttctttcgaagatttgctatctcatttgttagtctcctctgatgaaaacggtagattcttgtccgaagctgaaattgccaataatgtcttgttgttgttgtttgctggtcacgacacttctgctgtttccatcactttgttgatgaagtctttggctgaacaccctcaagtctacgacaacgttttgaaggaacaattaggtatcttggaagccaaggctccaggtgaaatgttgaactgggaagatatccaaaagatgagatactcctggtacgttgtttgtgaagtcatgagattgattccacctgttgttggttctttcagagaagctttggttgatttcgaatacgctggttacactattccaaagggttggaagatcatctggtctgctgtcatgactcacaaggaagaaaacaacttcccaaacgctactaagttcgacccatccagattcgaaggtgctggtccaaccccattcacctacgttccattcggtggtggtccaagaatgtgtttgggtaaggaattggctcgtgtcagaattttggttttcttacataacatcatgaccaaattcaaatgggacttgttgattccagacgaaaagatcggttacgacccattggctaccccagtcaagggtttgccagtcagattgcaccctcaccaagtg

SEQ ID NO: 28 - protein, 480 aa, Artemisia annua
MPMTVMLLFVFLLFIAICFFLVHRHNSTTTKNLPPGSFGWPFIGETLAYIRSKRGGDPERFTKERIEKYGSTLVFKTSVAGERMAVFCGPEGNKFLFGNENKLVASWWPNSVRILFEKCLITIRGDEAKWLRKMMFAYLGPDALSNRYTGTMEVVTRLHIQNHWQGKSELKVFETVRPYLFELACRLFLSLDDPKHVAELGTLFNTFLKGLTELPINIPGTRFYRAKRAANAIKKQLIVIIKQRRQALKQEDQSSSFEDLLSHLLVSSDENGRFLSEAEIANNVLLLLFAGHDTSAVSITLLMKSLAEHPQVYDNVLKEQLGILEAKAPGEMLNWEDIQKMRYSWYVVCEVMRLIPPVVGSFREALVDFEYAGYTIPKGWKIIWSAVMTHKEENNFPNATKFDPSRFEGAGPTPFTYVPFGGGPRMCLGKELARVRILVFLHNIMTKFKWDLLIPDEKIGYDPLATPVKGLPVRLHPHQV

SEQ ID NO: 29 - DNA, 1365 bp, Ricinus communis
  CDS (1)..(1365)
atggaattggtcatgttcccagtcttggctttggtttccactttgttcttgttggctttgcacttcatcatcagaactttgaaggaaagattattcggttctccaaatttgccaccaggtagattaggttggccattgattggtgaaaccccagctttcttcagagctggtttcgaagccaagccagaaaagttcatcggtgaaagaatggaaaagtacgactctcgtgttttcaagacctctttgttgggtaagcctttcgctgtcatttctggtactgctggtcacaagttcttgttttccaacgaaaacaaattggttaacttgtggtggccagaatccgtcagaatgttgttcaagtctgctttggtttccgttgttggtgacgaagccaagagaatcagaaagatgttgatgactttcttaggtttggatgctttgaagaactacactgaaagaattgacatggtcacccaacaacacatcagaacctactgggaaggtaaggaagaagttaccgtttactccactttgaaattgtacactttcaccttggcttgtaacttgtttgcctccatcaacgaccctgaaagattatccaagttgggtgctcacttcgatgttttcgttaagggtgttatctctttgccaatttccattccaggtactagattatacaaatccatgaaggctgccaacgccattagagaagaattgaaattgattgtccgtgacagaaaggaagctttggaaagaaagatggcttctccaactcaagatttgttgtcttatttgttggtcgactctgacaccaacggtcgtttcttgtctgaaatggaaatcttggacaacatcatgttgctattgtacgctgaacaattggaaattgctaactccaagaagccaggtgaattattgcaatgggaagatgtccaaaagatgagatactcctggaacgtcatctctgaagtcttgagattgtctccaccagtttcttctgcttacagacacgccattgttgactttacctacgaaggttacaccattccaaagggttggcaattgttcacctctttcggtactacccaccgtgacccagctttattcccaaacccagaaagattcgatgcttccagatttgaaggtaacggtccaccttcttactcttacatcccattcggtggtggtccaagaatgtgtattggttacgaatttgccagattggaaatgttgatcttcttacataacatcatcaagagattcaaatgggatatcttgatcccagatgaacaattcggttacaacccattattggctccatctcaaggtttcccagtcagattaagaccacaccactctcatcta

SEQ ID NO: 30 - protein, 455 aa, Ricinus communis
MELVMFPVLALVSTLFLLALHFIIRTLKERLFGSPNLPPGRLGWPLIGETPAFFRAGFEAKPEKFIGERMEKYDSRVFKTSLLGKPFAVISGTAGHKFLFSNENKLVNLWWPESVRMLFKSALVSVVGDEAKRIRKMLMTFLGLDALKNYTERIDMVTQQHIRTYWEGKEEVTVYSTLKLYTFTLACNLFASINDPERLSKLGAHFDVFVKGVISLPISIPGTRLYKSMKAANAIREELKLIVRDRKEALERKMASPTQDLLSYLLVDSDTNGRFLSEMEILDNIMLLLYAEQLEIANSKKPGELLQWEDVQKMRYSWNVISEVLRLSPPVSSAYRHAIVDFTYEGYTIPKGWQLFTSFGTTHRDPALFPNPERFDASRFEGNGPPSYSYIPFGGGPRMCIGYEFARLEMLIFLHNIIKRFKWDILIPDEQFGYNPLLAPSQGFPVRLRPHHSHL

SEQ ID NO: 31 - DNA, 1428 bp, Stevia rebaudiana
  CDS (1)..(1428)
atgattcaagttttgaccccaatcttgttgttcttgatcttcttcgtcttttggaaggtctacaagcaccaaaagaccaagatcaacttgcctccaggttctttcggttggccattcttgggtgaaactttagctttgttgagagctggttgggactctgaaccagaaagattcgttagagaaagaatcaagaagcatggttctccattggttttcaagacctctttgttcggtgacagattcgctgtcttgtgtggtccagctggtaacaaattcttgttctgtaacgaaaacaaattggttgcttcctggtggccagttccagttagaaagttgttcggtaagtccttgttgactatcagaggtgacgaagccaagtggatgagaaagatgttattgtcttacttgggtccagatgcctttgctacccactacgctgtcaccatggacgttgttacccgtcgtcacattgatgtccactggagaggtaaggaagaagttaacgttttccaaaccgtcaaattgtacgctttcgaattggcttgtagattattcatgaacttggatgacccaaaccatattgccaaattaggttctttattcaacatcttcttgaagggtatcatcgaattgccaattgatgttccaggtactagattctactcctccaagaaggctgctgctgccatcagaattgaattgaagaaattgatcaaggccagaaagttggaattgaaggaaggtaaggcttcttcctctcaagatttgctatcccacttattgacctctccagacgaaaatggtatgttcttgactgaagaagaaattgtcgacaacatcttattgctattgttcgctggtcacgacacctctgctctatccattactttgttgatgaaaactttgggtgaacactctgatgtttacgacaaggtcttaaaggaacaattggaaatctccaagactaaggaagcttgggaatctttgaaatgggaagatatccaaaagatgaagtactcctggtctgttatctgtgaagtcatgagattgaaccctccagtcattggtacttacagagaagctttggtcgatatcgactacgctggttacaccattccaaagggttggaagttgcactggtctgccgtttccactcaaagagatgaagctaacttcgaagatgtcaccagatttgacccatctcgtttcgaaggtgctggtccaactccattcacttttgttccattcggtggtggtccaagaatgtgtttgggtaaggaattcgctagattagaagttttggctttcttgcacaacattgtcaccaactttaaatgggacttgttgattccagacgaaaagatcgaatacgacccaatggctactccagccaagggtttgccaatcagattgcaccctcaccaagtc

SEQ ID NO: 32 - protein, 476 aa, Stevia rebaudiana
MIQVLTPILLFLIFFVFWKVYKHQKTKINLPPGSFGWPFLGETLALLRAGWDSEPERFVRERIKKHGSPLVFKTSLFGDRFAVLCGPAGNKFLFCNENKLVASWWPVPVRKLFGKSLLTIRGDEAKWMRKMLLSYLGPDAFATHYAVTMDVVTRRHIDVHWRGKEEVNVFQTVKLYAFELACRLFMNLDDPNHIAKLGSLFNIFLKGIIELPIDVPGTRFYSSKKAAAAIRIELKKLIKARKLELKEGKASSSQDLLSHLLTSPDENGMFLTEEEIVDNILLLLFAGHDTSALSITLLMKTLGEHSDVYDKVLKEQLEISKTKEAWESLKWEDIQKMKYSWSVICEVMRLNPPVIGTYREALVDIDYAGYTIPKGWKLHWSAVSTQRDEANFEDVTRFDPSRFEGAGPTPFTFVPFGGGPRMCLGKEFARLEVLAFLHNIVTNFKWDLLIPDEKIEYDPMATPAKGLPIRLHPHQV

SEQ ID NO: 33 - DNA, 1575 bp, Arabidopsis thaliana
  CDS (1)..(1575)
atggaatctttagtcgttcacaccgtcaatgccatctggtgtattgtcattgttggtattttctctgttggttaccacgtttacggtcgtgccgttgttgaacaatggagaatgagaagatctttgaaattgcaaggtgtcaagggtccaccaccatccattttcaacggtaatgtctctgaaatgcaaagaatccaatctgaagctaagcactgttccggtgacaacatcatttctcacgattactcctcctctttgttccctcactttgaccactggagaaagcaatacggtagaatctacacctactccactggtttgaaacaacatttgtacatcaaccatccagaaatggtcaaggaattatctcaaaccaacactttgaacttaggtcgtatcactcacatcaccaagagattgaacccaatcttaggtaacggtatcatcacttccaacggtccacactgggctcatcaaagaagaattattgcttacgaattcacccacgacaaaatcaagggtatggtcggtttgatggtcgaatctgccatgccaatgttgaacaaatgggaagaaatggttaagagaggtggtgaaatgggttgtgacatccgtgttgacgaagatttgaaggatgtttctgctgatgtcattgctaaggcttgtttcggttcctctttctccaagggtaaggctatcttctccatgatcagagacttgttgactgccatcactaagagatctgttttgttcagattcaacggtttcaccgacatggttttcggttccaagaagcatggtgatgtcgatatcgatgctttggaaatggaattggaatcttctatctgggaaaccgttaaggaaagagaaattgaatgtaaggacactcacaagaaggatttgatgcaattaatcttggaaggtgccatgagatcttgtgacggtaacttgtgggacaagtctgcttacagaagatttgttgtcgacaactgtaaatccatctactttgccggtcacgactctactgctgtctccgtttcctggtgtttgatgttgctagctttgaacccatcctggcaagtcaagatcagagatgaaatcttatcttcttgtaagaacggtattccagatgctgaatccattccaaacttgaagaccgttaccatggtcattcaagaaactatgagattgtacccaccagctccaattgtcggtagagaagcttccaaggacatcagattaggtgacttggttgttccaaagggtgtttgtatctggactttgattccagctttgcaccgtgacccagaaatctggggtccagatgctaacgacttcaagccagaaagattctctgaaggtatttccaaggcttgtaaatacccacaatcttacatcccattcggtttgggtccaagaacctgtgtcggtaagaacttcggtatgatggaagtcaaagttttggtttctttgattgtttccaagttctctttcaccttgtctccaacttaccaacactctccatctcacaagttgttggttgaacctcaacacggtgttgtcattagagtcgtt

SEQ ID NO: 34 - protein, 525 aa, Arabidopsis thaliana
MESLVVHTVNAIWCIVIVGIFSVGYHVYGRAVVEQWRMRRSLKLQGVKGPPPSIFNGNVSEMQRIQSEAKHCSGDNIISHDYSSSLFPHFDHWRKQYGRIYTYSTGLKQHLYINHPEMVKELSQTNTLNLGRITHITKRLNPILGNGIITSNGPHWAHQRRIIAYEFTHDKIKGMVGLMVESAMPMLNKWEEMVKRGGEMGCDIRVDEDLKDVSADVIAKACFGSSFSKGKAIFSMIRDLLTAITKRSVLFRFNGFTDMVFGSKKHGDVDIDALEMELESSIWETVKEREIECKDTHKKDLMQLILEGAMRSCDGNLWDKSAYRRFVVDNCKSIYFAGHDSTAVSVSWCLMLLALNPSWQVKIRDEILSSCKNGIPDAESIPNLKTVTMVIQETMRLYPPAPIVGREASKDIRLGDLVVPKGVCIWTLIPALHRDPEIWGPDANDFKPERFSEGISKACKYPQSYIPFGLGPRTCVGKNFGMMEVKVLVSLIVSKFSFTLSPTYQHSPSHKLLVEPQHGVVIRVV

SEQ ID NO: 35 - DNA, 1437 bp, Ixeris dentata var. albiflora
  CDS (1)..(1437)
atggatgccgttgccgtcaactctgaaaccatgtcccacgttgttttcattccattcccagctcaatctcacatcaagtgtatgttgaagttggcccgtctattacaccacaagggtttacacatcactttcgtcaacactgaattgaaccacaaccaattgttatcttctggtggtccaaactctttggacggtgaaccaggtttcagattcaagaccattccagatggtgttccagaaggtgctccagacttcatgtacgctttatgtgactctgtcttgaacaaaatgttggacccatttgtcgatttgattggtagattggaatctccagccacctgtatcatcggtgacggtatgatgcctttcactgttgctgctgctgaaaagttgaaattgccaattatgcatttctggactttcccagctgctgctttcttgggttactaccaagctccaaacttgattgaaaagggtttcatcccacctaaggacgaatcctggtccaccaacggttacttggaaaccgttgttgactccatttctggtttggaaggtttcagaatcagagatatcccagcttacttcagaaccactgacccaaacgattctgatttcaactacatcatcgaatgtgttaaggccatcagaaaggtttccaacattgtcttgcacactttcgaagaattggaatctaccattatcaaggccttgcaaccaatgatcccacacgtctacaccattggtccattggaattgttgttgaacccaatcaagttagaagaagaaactgaaaagttggacattaaaggttactctttatggaaggaagatgacgaatgtttgaaatggttggactccaaggaaccaaactccgtcatttacgtcaactttggttctttgatctccatgtccaaggaacaattagctgaatttggttggggtttggttaactctaaccactgtttcttgtgggttatcagaagagacttggttgtcggtgattctgctccattgcctccagaattgaaagaacgtatcaacgaaagaggtttcatcgcttcctggtgtccacaagaaaaggtcttgaaacattcctctgttggtggtttcttgactcactgtggttggggttccatcatcgaatctctatctgctggtgtcccaatgttgtgttggccatacttgtgggaccaaccaaccaactgtcgtcaagcttgtaaggaatgggaagttggtttggaaattgaaggtaacgttaacaaggatgaagtcgaaagattgaccagagaattgatcggtggtgaaaagggtaagcaaatgagatccaaggctttggaatggaagaagaagatcgaaattgctactggtccaaagggttcttcttctttaaatgtcgaaagattggctaacgacattaacatgttctccagaaat

SEQ ID NO: 36 - protein, 479 aa, Ixeris dentata var. albiflora
MDAVAVNSETMSHVVFIPFPAQSHIKCMLKLARLLHHKGLHITFVNTELNHNQLLSSGGPNSLDGEPGFRFKTIPDGVPEGAPDFMYALCDSVLNKMLDPFVDLIGRLESPATCIIGDGMMPFTVAAAEKLKLPIMHFWTFPAAAFLGYYQAPNLIEKGFIPPKDESWSTNGYLETVVDSISGLEGFRIRDIPAYFRTTDPNDSDFNYIIECVKAIRKVSNIVLHTFEELESTIIKALQPMIPHVYTIGPLELLLNPIKLEEETEKLDIKGYSLWKEDDECLKWLDSKEPNSVIYVNFGSLISMSKEQLAEFGWGLVNSNHCFLWVIRRDLVVGDSAPLPPELKERINERGFIASWCPQEKVLKHSSVGGFLTHCGWGSIIESLSAGVPMLCWPYLWDQPTNCRQACKEWEVGLEIEGNVNKDEVERLTRELIGGEKGKQMRSKALEWKKKIEIATGPKGSSSLNVERLANDINMFSRN

SEQ ID NO: 37 - DNA, 1446 bp, Ricinus communis
  CDS (1)..(1446)
atgggttccattgtccgtgaccacgacaagccacacgttgtttgtgttccatacccagctcaaggtcacgttaacccaatggtcaaattggccaagttgttgcactacaacgatttccacgtcactttcgtcaacactgaatacaaccacagaagattattgaactccagaggtccttcttctttggacggtttgccagatttcagattcgaagccatctctgacggtttgccaccatctgatgctaacgctacccaagatatcccatctctatgtgactctacctccaagaactctttggctccattcagaaacttgttgttgaagttgaaatcctctgactctttgccaccagttacctgtatcatttctgatgcttgtatgtccttcactttggatgctgctgaagaatttggtattccagaaatcttattctggaccccatcttcttgtggtgttttgggttactctcaataccacactttgattgaaaagggtttgactccattaaaggacgcctcttacttgaccaacggttacttggaaaccactttggactggattccaggtatgaaggatatcagattcagagatttgccatctttcatcagaaccactgacagaaacgatatcatgttgaactttgttgtccgtgaattggaaagaacttccagagcttctgctgttgttttcaacactttctacgccttcgaaaaggacgtcttagatgtcttatccaccatgttcccaccaatctactccatcggtccattgcaattgttggttgaccaaatcccaattgacagaaacttgggtaacattggttccaacttatggaaggaacaaccagaatgtattgactggttggacaccaaggaaccaaactctgttgtctacgtcaacttcggttccatcactgttatcactcctcaacaaatgattgaattcgcttggggtctagcttcttctaagaaaccattcttatggatcatcagaccagacttggttatcggtgaaaacgctatgttgccagctgaattcgtttctgaaaccaaggatcgtggtatgttggcttcttggggtcctcaagaacaaattttgaaacatccagctgtcggtggtttcttgtctcacatgggttggaactccactttggactccatgtccggtggtgtcccaatggtttgttggccattctttgctgaacaacaaaccaactgtagatttgcttgtaccgaatggggtgttggtatggaaattgacaacaatgtcaagagagatgaagtcaagaagttggttgaagttttgatggacggtaagaaaggtaaggaaatgaagtccaaggccatggaatggaaaaccaaggctgaagaagctgccaagccaggtggttcctctcataacaacttggacagattagtcaagttcatcaagggtcaaaagaat

SEQ ID NO: 38 - protein, 482 aa, Ricinus communis
MGSIVRDHDKPHVVCVPYPAQGHVNPMVKLAKLLHYNDFHVTFVNTEYNHRRLLNSRGPSSLDGLPDFRFEAISDGLPPSDANATQDIPSLCDSTSKNSLAPFRNLLLKLKSSDSLPPVTCIISDACMSFTLDAAEEFGIPEILFWTPSSCGVLGYSQYHTLIEKGLTPLKDASYLTNGYLETTLDWIPGMKDIRFRDLPSFIRTTDRNDIMLNFVVRELERTSRASAVVFNTFYAFEKDVLDVLSTMFPPIYSIGPLQLLVDQIPIDRNLGNIGSNLWKEQPECIDWLDTKEPNSVVYVNFGSITVITPQQMIEFAWGLASSKKPFLWIIRPDLVIGENAMLPAEFVSETKDRGMLASWGPQEQILKHPAVGGFLSHMGWNSTLDSMSGGVPMVCWPFFAEQQTNCRFACTEWGVGMEIDNNVKRDEVKKLVEVLMDGKKGKEMKSKAMEWKTKAEEAAKPGGSSHNNLDRLVKFIKGQKN

SEQ ID NO: 39 - DNA, 1374 bp, Ixeris dentata var. albiflora
  CDS (1)..(1374)
atggctgaagaacacaacaagaccaacaactcttctcctcacgttgtcatcttcccattcccatctcaaggtcacattaacccattgattcaatttgccaagagattgtcctccaagggtgtcaagccaactttgatcactaccatctacattgctaagacctctccatacccaaactcttccattgttgttgaaccaatttctgatggtttcgacgacggtggtttcaagtctgccacttctgctgaatcttacattgacactttccaccaagttggttccaaatctctagctaacttgatcagaaagttggtcaacgaaggtaaccatgtcgatgctatcatctacgactctttcgtcacctgggctttggatgttgctatggaatacggtattgacggtggttgtttcttcacccaagcttgtgctgtcaacaacatctactaccatgtttacaagggtgtcttggaaattccattgcaagctgctgctccaccaaccgtcactatcttattgcctgaattgcctcaattacaattatgggaaactccatcctttgtccacaacccaggtccatacccaggttgggctcacattgttttcaaccaattcccaaacatccacaacgccagatgggttttctccaacactttcttcaaattggaagaacaagttatcaaatggatgagattgatgtggccattgatggttgtcggtccaactgttccatccatgtacttggacaagagattagaagatgacgatgactacggtatgtctttgttgaagccaaaccacattgaatgtatgggttggttgaataacaaaccaaagggttccgttgtctacgtttccttcggttcctacggtgaattaggtgttgctcaaatggaagaaattgcttggggtttgaacgaatcttccgtcaactatttatgggttgtcagagaaactgaaaaggaaaagttgccaaagtctttcttggctaatggtttgattgttgaatggtgtcgtcaattggaagttttggctcacgaagctgtcggttgtttcgtcactcactgtggtttcaactcctctttggaaaccatctctttgggtgtcccagttgttgccatcccacaatggaccgatcaaaccaccaacgctaagtgtttggaagatatctggggtgttggtatcagagccaagactccagtcaccagaaccaacttggtctggtgtatcaaggaaatcatggaaggtgaacgtggtgctgttgctagaaagaacgccatcaagtggaaggacttggccattgaagctgtctctccaggtggttcctctgacaaggacatcaacgaatttgtttctcaattgtctccaatcaaatgt

SEQ ID NO: 40 - protein, 458 aa, Ixeris dentata var. albiflora
MAEEHNKTNNSSPHVVIFPFPSQGHINPLIQFAKRLSSKGVKPTLITTIYIAKTSPYPNSSIVVEPISDGFDDGGFKSATSAESYIDTFHQVGSKSLANLIRKLVNEGNHVDAIIYDSFVTWALDVAMEYGIDGGCFFTQACAVNNIYYHVYKGVLEIPLQAAAPPTVTILLPELPQLQLWETPSFVHNPGPYPGWAHIVFNQFPNIHNARWVFSNTFFKLEEQVIKWMRLMWPLMVVGPTVPSMYLDKRLEDDDDYGMSLLKPNHIECMGWLNNKPKGSVVYVSFGSYGELGVAQMEEIAWGLNESSVNYLWVVRETEKEKLPKSFLANGLIVEWCRQLEVLAHEAVGCFVTHCGFNSSLETISLGVPVVAIPQWTDQTTNAKCLEDIWGVGIRAKTPVTRTNLVWCIKEIMEGERGAVARKNAIKWKDLAIEAVSPGGSSDKDINEFVSQLSPIKC

SEQ ID NO: 41 - DNA, 1362 bp, Populus trichocarpa
  CDS (1)..(1362)
atggacaacaagaagtctcatgtcattgtcttgacctacccagctcaaggtcacatcaacccattgttgcaattcgccaagagattagcttccaagggtttgaaggccactttggctaccacctactacactgttaactccattgacgctccaactgtcggtgttgaaccaatctctgatggtttcgatgaaggtggtttcaagcaagcttcctctctagatgtctacttggaatctttcaagaccgtcggttccagaaccttgactgaattagtctttaaattcaaggcttctggttctcctgttaactgtgttgtttacgactccatgttgccatgggctttggacgttgccagagatttgggtatctacgctgctgccttcatgaccacctctgcttccgtctgttccatgtactggagaattgacttaggtttattgtctttgccattgaagcaacaaaccgctaccgtttctttgccaggtttgccaccattgggttgttgtgatttgccatctttcttagctgaaccaacttctcaaactgcttacttggaagttatcatggaaaagttccactccttgaacgaagatgactgggttttctgtaactctttcgaagatttggaaattgaattggtcaaggctatgagaggtaaatggccattggttatggttggtccaatggttccatctgcctacttggaccaacaaattgatggtgaccgtgcctacggtgcttctttgtggaaaccaacttcttctcaatgtttcacctggttggacactaagcctccaagatctgtcatctacgtttcctttggttccatgggtaacatctccgctgaacaagttgaagaaattgcttggggtttgaaggcttccaacagaccattcttatgggttatgaaggaatctgaaaagaaattgccaactggtttcttgaactctgtcggtgaaaccggtatggttgtttcctggtgtaaccaattggaagtcttggctcaccaagctatcggttgtttcgtcacccactgtggttggaactccactttggaaggtttgggtttaggtgttccaatggtttgtgttactgaaagatctgaccaaccaatgaacgctaagttcgttgaagatgtctggaaggtcggtgtcagagctaagaaggacgaagttggtattgtcactagagaagaattggaaaagtgtatcagaggtgtcatggacggtgaaaacggtgaagaaatcaagagaaacgccaacaaatggagagaattagctcgttctgccgtttccgtcggtggttcttctgacatgaacatcaatgaatttgttgtcaaattgttggaaggtaagaagggg

SEQ ID NO: 42 - protein, 454 aa, Populus trichocarpa
MDNKKSHVIVLTYPAQGHINPLLQFAKRLASKGLKATLATTYYTVNSIDAPTVGVEPISDGFDEGGFKQASSLDVYLESFKTVGSRTLTELVFKFKASGSPVNCVVYDSMLPWALDVARDLGIYAAAFMTTSASVCSMYWRIDLGLLSLPLKQQTATVSLPGLPPLGCCDLPSFLAEPTSQTAYLEVIMEKFHSLNEDDWVFCNSFEDLEIELVKAMRGKWPLVMVGPMVPSAYLDQQIDGDRAYGASLWKPTSSQCFTWLDTKPPRSVIYVSFGSMGNISAEQVEEIAWGLKASNRPFLWVMKESEKKLPTGFLNSVGETGMVVSWCNQLEVLAHQAIGCFVTHCGWNSTLEGLGLGVPMVCVTERSDQPMNAKFVEDVWKVGVRAKKDEVGIVTREELEKCIRGVMDGENGEEIKRNANKWRELARSAVSVGGSSDMNINEFVVKLLEGKKG

SEQ ID NO: 43 - DNA, 1377 bp, Nicotiana tabacum
  CDS (1)..(1377)
atgaccactcaaaaggctcactgtttgatcttaccatacccagctcaaggtcacatcaacccaatgttgcaattttccaagagattacaatctaagggtgtcaagatcaccattgctgctaccaagtctttcttaaagaccatgcaagaattgtccacttctgtctctgttgaagctatctctgatggttacgatgacggtggtagagaacaagctggtactttcgttgcttacatcaccagattcaaggaagttggttctgacactctatcccaattaatcggtaagttgaccaactgtggttgtccagtttcttgtatcgtctacgatcctttcttgccatgggctgtcgaagtcggtaacaactttggtgttgccactgctgctttcttcactcaatcttgtgctgttgacaacatctactaccatgtccacaaaggtgttttgaaattgccaccaactgatgttgacaaggaaatttccattccaggtttgttgaccattgaagcttctgatgttccatctttcgtttccaacccagaatcttccagaatcttggaaatgttggtcaaccaattctccaatttggaaaacactgactgggttttgatcaactctttctacgaattggaaaaggaagtcattgactggatggccaagatctacccaatcaagaccattggtccaaccattccatccatgtacttggacaaaagattaccagatgacaaggaatacggtttgtccgtctttaaaccaatgaccaatgcttgtttgaactggttgaaccaccaaccagtttcttccgttgtctacgtttctttcggttctttggctaagttggaagctgaacaaatggaagaattggcttggggtttgtccaactccaacaagaacttcttatgggttgtcagatctactgaagaatccaaattgccaaacaacttcttggaagaattggcttctgaaaagggtttggttgtttcctggtgtccacaattacaagttttggaacacaagtccatcggttgtttcttgactcactgtggttggaactctactttggaagccatctctttgggtgttccaatgattgccatgcctcactggtctgaccaaccaaccaacgccaagttggtcgaagatgtctgggaaatgggtatcagaccaaagcaagatgaaaagggtttagtccgtcgtgaagtcattgaagaatgtatcaagattgtcatggaagaaaagaagggtaagaagatcagagaaaacgccaagaaatggaaggaattggccagaaaggctgttgacgaaggtggttcttctgacagaaacattgaagaattcgtttccaaattggtcaccattgcttctgtcgagagt

SEQ ID NO: 44 - protein, 459 aa, Nicotiana tabacum
MTTQKAHCLILPYPAQGHINPMLQFSKRLQSKGVKITIAATKSFLKTMQELSTSVSVEAISDGYDDGGREQAGTFVAYITRFKEVGSDTLSQLIGKLTNCGCPVSCIVYDPFLPWAVEVGNNFGVATAAFFTQSCAVDNIYYHVHKGVLKLPPTDVDKEISIPGLLTIEASDVPSFVSNPESSRILEMLVNQFSNLENTDWVLINSFYELEKEVIDWMAKIYPIKTIGPTIPSMYLDKRLPDDKEYGLSVFKPMTNACLNWLNHQPVSSVVYVSFGSLAKLEAEQMEELAWGLSNSNKNFLWVVRSTEESKLPNNFLEELASEKGLVVSWCPQLQVLEHKSIGCFLTHCGWNSTLEAISLGVPMIAMPHWSDQPTNAKLVEDVWEMGIRPKQDEKGLVRREVIEECIKIVMEEKKGKKIRENAKKWKELARKAVDEGGSSDRNIEEFVSKLVTIASVES

SEQ ID NO: 45 - DNA, 1434 bp, Vaccaria hispanica
  CDS (1)..(1434)
atgtccaacaatgaaaacaatgccactcaagttatcgttttgccataccacggtcaaggtcacatgaacaccatggttcaatttgccaagagattagcttggaagggtgtccacgtcaccattgctaccactttcaacactatccaacaaatgaaattgaacatttcttcttacaactccatcactttggaaccaatctacgatgacactgatgactccactttgcacatcaaggacagaatggccagatttgaagctgaagccgcttccaatttgaccagagttttggaagccaagaaacaacaacaagctttaaacaagaagtgtttgttggtttaccacggttctttgaactgggctttagtcgttgctcaccaacaaaacgttgctggtgctgctttcttcaccgctgcttctgcttctttcgcttgttactactacttgcatttggaatctcaaggtaagggtgtcgacttggaagaattaccatccatcttaccaccaccaaaggtcattgttcaaaagttgccaaagtctttcttagcttacggtgacaacaactctcacaacaacaacaacaacaacaacaacaacaacaacaacaacaacatgggtttgcacccattggtcttgtggttgttgaaagattacggtaactccgtcaaggctgacttcgttttgttgaactctttcgacaaattggaagaagaagctatcaaatggatctctaacatctgttccgtcaagactatcggtccaaccattccatctacctacttggacaagcaaattgaaaacgatgttgactacggtttcaaccaatacaagccaaccaatgaagattgtatgaaatggttggacaccaaggaagccaactccgttgtctacatcgccttcggttctgttgctcgtttgtctgtcgaacaaatggctgaaattgctaaggctttggaccattcttccaagtctttcatctgggttgtcagagaaactgaaaaggaaaagttgccagtcgatttggttgaaaagatctctggtcaaggtatggttgtcccatgggctcctcaattggaagttttggctcacgatgctgtcggttgtttcgtttctcactgtggttggaactccaccattgaagctttgtctttcggtgttccaattttggccatgcctcaattcttagatcaattggtcgatgctcatttcgttgacagagtctggggtgtcggtattgctccaactgtcgatgaaaacgatttggttactcaagaagaaatctccagatgtctagacgaaatgatgggtggtggtccagaaggtgaaaagatcaagaagaacgttgccatgtggaaggaattgaccaaggaagctttggacaagggtggttcctctgacaagcacattgacgaaatcattgaatggttatcttcctcc

SEQ ID NO: 46 - protein, 478 aa, Vaccaria hispanica
MSNNENNATQVIVLPYHGQGHMNTMVQFAKRLAWKGVHVTIATTFNTIQQMKLNISSYNSITLEPIYDDTDDSTLHIKDRMARFEAEAASNLTRVLEAKKQQQALNKKCLLVYHGSLNWALVVAHQQNVAGAAFFTAASASFACYYYLHLESQGKGVDLEELPSILPPPKVIVQKLPKSFLAYGDNNSHNNNNNNNNNNNNNNMGLHPLVLWLLKDYGNSVKADFVLLNSFDKLEEEAIKWISNICSVKTIGPTIPSTYLDKQIENDVDYGFNQYKPTNEDCMKWLDTKEANSVVYIAFGSVARLSVEQMAEIAKALDHSSKSFIWVVRETEKEKLPVDLVEKISGQGMVVPWAPQLEVLAHDAVGCFVSHCGWNSTIEALSFGVPILAMPQFLDQLVDAHFVDRVWGVGIAPTVDENDLVTQEEISRCLDEMMGGGPEGEKIKKNVAMWKELTKEALDKGGSSDKHIDEIIEWLSSS

SEQ ID NO: 47 - DNA, 1443 bp, Streptococcus mutans
  CDS (1)..(1443)
atgccaatcatcaacaagaccatgttgatcacttacgctgactctctaggtaagaacttgaaagaattgaatgaaaacattgaaaactacttcggtgatgctgtcggtggtgttcacttgttgcctttcttcccatccaccggtgacagaggtttcgctccaattgactaccatgaagtcgactccgccttcggtgactgggatgacgttaagtgtttgggtgaaaagtactacttgatgtttgacttcatgatcaaccacatctccagacaatctaagtactacaaggactaccaagaaaagcacgaagcttctgcttacaaggatttgttcttgaactgggacaaattctggccaaagaacagaccaactcaagaagatgtcgacttgatctacaagagaaaggaccgtgccccaaagcaagaaatccaatttgccgatggttctgttgaacacttatggaacactttcggtgaagaacaaatcgatttggatgtcaccaaggaagttaccatggacttcatcagatccaccattgaaaacttggctgctaacggttgtgacttgatcagattggatgctttcgcttacgctgttaagaagctagacaccaacgatttcttcgtcgaaccagaaatctggactttgttggacaaggtccgtgacattgctgctgtttctggtgctgaaattttgccagaaattcacgaacattacactatccaattcaagattgctgaccacgactactacgtttacgactttgctttgccaatggttactttatactctttgtactcctccaaggtcgacagattagctaaatggttgaaaatgtctccaatgaagcaattcaccactttggacacccacgacggtattggtgttgtcgatgtcaaggatatcttgaccgatgaagaaatcacttacacttccaatgaattatacaaggtcggtgccaacgttaacagaaaatactctactgctgaatacaacaacttggatatctaccaaatcaactctacctactactctgctttgggtgacgatgaccaaaagtatttcttggccagattaatccaagctttcgctccaggtatcccacaagtctactacgttggtttcttggccggtaagaacgatttggaattgttggaatccaccaaggaaggtagaaacatcaacagacactactactcttctgaagaaattgctaaggaagtcaaaagaccagttgttaaggctttgttgaacttattcacttacagaaaccaatctgctgcctttgacttggatggtagaattgaagttgaaaccccaaacgaagctaccattgttattgaaagacaaaacaaagatggttcccacattgccaaggctgaaatcaacttgcaagacatgacttaccgtgtcactgaaaacgaccaaaccatttctttcgaa

SEQ ID NO: 48 - protein, 481 aa, Streptococcus mutans
MPIINKTMLITYADSLGKNLKELNENIENYFGDAVGGVHLLPFFPSTGDRGFAPIDYHEVDSAFGDWDDVKCLGEKYYLMFDFMINHISRQSKYYKDYQEKHEASAYKDLFLNWDKFWPKNRPTQEDVDLIYKRKDRAPKQEIQFADGSVEHLWNTFGEEQIDLDVTKEVTMDFIRSTIENLAANGCDLIRLDAFAYAVKKLDTNDFFVEPEIWTLLDKVRDIAAVSGAEILPEIHEHYTIQFKIADHDYYVYDFALPMVTLYSLYSSKVDRLAKWLKMSPMKQFTTLDTHDGIGVVDVKDILTDEEITYTSNELYKVGANVNRKYSTAEYNNLDIYQINSTYYSALGDDDQKYFLARLIQAFAPGIPQVYYVGFLAGKNDLELLESTKEGRNINRHYYSSEEIAKEVKRPVVKALLNLFTYRNQSAAFDLDGRIEVETPNEATIVIERQNKDGSHIAKAEINLQDMTYRVTENDQTISFE

SEQ ID NO: 49 - DNA, 1392 bp, Lobelia erinus
  CDS (1)..(1392)
atggacaacaaccatttgggtgaaactttgttgccattggctccaaagaacggtagaagagtcttgttcttcccatacccattacaaggtcacatttctccaatgttgaacttggccaacttgttgcactccaagggtttcaccatcaccatcatccacaccaatttgaactctccaaaccaatctgactacccacacttcactttcagaccatttgatgacggtttcccaccatactccaagggttggcaattggctaccttgtgttccagatgtgttgaaccattcagagaatgtttggctcaaatcttcttgtctgaccacactgctccagaaggtgaaagagaatctattgcttgtttgattgctgatggtttatggaacttcttgggtgctgctgtctacaactttaaattgccaatgattgttttgagaactggtaacatgtctaacattgttgccaacgttaagttgccatgtttcatcgaaaagggttacttcgaccataccaaggaaggttccaagttggaagctgctgtcccagaattcccaaccatcaagttcaaagatatcttgaaaacctacggttctaacccaaaggccatctgtgaaactttgactgctttgttgaaggaaatgagagcttcttctggtgtcatctggaactcttgtaaggaattagaacaatctgaattacaaatgatctgtaaggaattcccagttcctcatttcttgattggtcctttgcacaaatacttcccagcttcttcttcttccttggttgcccacgacccatcttccatttcctggttgaactccaaggctccaaactctgttttgtacgtttctttcggttccatctcttccatggacgaagctgaatttctagaaactgcttggggtttggccaactccatgcaacaattcttatgggttgtcagaccaggttctgtcagaggttctcaatggttggaatctttaccagatggtttcattgacaagttggatggtagaggtcacattgtcaaatgggctcctcaacaagaagtcttagctcaccaagctaccggtggtttctggactcactgtggttggaactccactttagaatccatgtgtgaaggtgtcccaatgatttgttcccacggtatcatggaccaaccaatcaatgctcgttacgttaccgatgtctggaaggttggtattgaattggaaaagggttttgactctgaagaaatcaagatggccatccgtcgtttgatggttgacaaggaaggtcaagaaatcagagaaagatcttccagattgaaggaatctttgtccaactgtttgaagcaaggtggttcttcccacgattctgtcgaatctttggttgaccacatcctatccttc

SEQ ID NO: 50 - protein, 464 aa, Lobelia erinus
MDNNHLGETLLPLAPKNGRRVLFFPYPLQGHISPMLNLANLLHSKGFTITIIHTNLNSPNQSDYPHFTFRPFDDGFPPYSKGWQLATLCSRCVEPFRECLAQIFLSDHTAPEGERESIACLIADGLWNFLGAAVYNFKLPMIVLRTGNMSNIVANVKLPCFIEKGYFDHTKEGSKLEAAVPEFPTIKFKDILKTYGSNPKAICETLTALLKEMRASSGVIWNSCKELEQSELQMICKEFPVPHFLIGPLHKYFPASSSSLVAHDPSSISWLNSKAPNSVLYVSFGSISSMDEAEFLETAWGLANSMQQFLWVVRPGSVRGSQWLESLPDGFIDKLDGRGHIVKWAPQQEVLAHQATGGFWTHCGWNSTLESMCEGVPMICSHGIMDQPINARYVTDVWKVGIELEKGFDSEEIKMAIRRLMVDKEGQEIRERSSRLKESLSNCLKQGGSSHDSVESLVDHILSF

SEQ ID NO: 51 - DNA, 1380 bp, Arabidopsis thaliana
  CDS (1)..(1380)
atggaagaaagaaagggtagaagaatcatcatgttcccattaccattcccaggtcacttcaacccaatgattgaattggctggtatctttcatcaccgtggtttctccgttaccatcttgcacacttcttacaacttcccagacccatccagacacccacacttcactttcagaaccatttctcacaacaaggaaggtgaagaagatccattatctcaatctgaaacctcttccatggacttgattgtcttggtcagaagattaaagcaacgttacgctgaaccattcagaaagtccgttgctgctgaagtcggtggtggtgaaaccgtttgttgtttggtttctgatgctatctggggtaagaacactgaagttgttgctgaagaaatcggtgtcagaagagttgttttgagaactggtggtgcctcttctttctgtgcctttgctgctttcccattattgagagacaagggttacttgccaatccaagattctcgtttggatgaacctgttactgaattgcctccattgaaggtcaaggacttaccagtcatggaaaccaatgaaccagaagaattgtacagagttgttaacgacatggttgaaggtgctaaatcttcttctggtgtcatctggaacactttcgaagatttggaaagattgtctttgatgaactgttcctccaaattgcaagttccattcttcccaatcggtccattccacaagtactctgaagatccaactccaaagactgaaaacaaggaagataccgactggttggacaagcaagaccctcaatccgttgtctacgcctcctttggttctttggccgctattgaagaaaaggaattcttggaaattgcttggggtctaagaaactctgaaagaccattcttatgggttgttagaccaggttccgtccgtggtactgaatggttggaatctctaccattgggtttcatggaaaacatcggtgacaagggtaagattgtcaaatgggctaaccaattggaagttttggctcacccagccattggtgctttctggacccactgtggttggaactccactttggaatccatctgtgaaggtgtcccaatgatctgtacctcctgttttaccgaccaacatgtcaacgccagatacattgtcgacgtctggagagtcggtatgttgttggaaagatccaagatggaaaagaaggaaatcgaaaaggttttgagatctgttatgatggaaaagggtgatggtttgagagaaagatctttgaaattgaaggaaagagctgatttctgtttgtccaaggacggttcttcttccaagtacttggacaaattggtttcccacgtcttatctttcgactcttacgctttcgcttct

SEQ ID NO: 52 - protein, 460 aa, Arabidopsis thaliana
MEERKGRRIIMFPLPFPGHFNPMIELAGIFHHRGFSVTILHTSYNFPDPSRHPHFTFRTISHNKEGEEDPLSQSETSSMDLIVLVRRLKQRYAEPFRKSVAAEVGGGETVCCLVSDAIWGKNTEVVAEEIGVRRVVLRTGGASSFCAFAAFPLLRDKGYLPIQDSRLDEPVTELPPLKVKDLPVMETNEPEELYRVVNDMVEGAKSSSGVIWNTFEDLERLSLMNCSSKLQVPFFPIGPFHKYSEDPTPKTENKEDTDWLDKQDPQSVVYASFGSLAAIEEKEFLEIAWGLRNSERPFLWVVRPGSVRGTEWLESLPLGFMENIGDKGKIVKWANQLEVLAHPAIGAFWTHCGWNSTLESICEGVPMICTSCFTDQHVNARYIVDVWRVGMLLERSKMEKKEIEKVLRSVMMEKGDGLRERSLKLKERADFCLSKDGSSSKYLDKLVSHVLSFDSYAFAS

SEQ ID NO: 53 - DNA, 2139 bp, Gibberella fujikuroi
  CDS (1)..(2139)
atggctgaattggacactttggatatcgtcgttttgggtgttatcttcttgggtactgttgcttacttcaccaagggtaagttgtggggtgtcaccaaggatccatacgctaacggttttgccgctggtggtgcttccaagccaggtagaaccagaaacattgttgaagccatggaagaatctggtaagaactgtgttgttttctacggttctcaaaccggtactgctgaagattacgcttccagattagctaaggaaggtaagtccagattcggtttgaacaccatgattgctgacttagaagattacgacttcgacaacttggataccgttccatctgacaacattgtcatgttcgttttggctacctacggtgaaggtgaacctaccgacaatgctgttgacttctacgaattcatcactggtgaagatgcttctttcaacgaaggtaacgaccctccattgggtaacttgaattatgtcgctttcggtttaggtaacaacacctacgaacactacaactccatggttagaaatgtcaacaaagctttggaaaagctaggtgcccacagaattggtgaagctggtgaaggtgacgacggtgctggtactatggaagaagatttcttggcttggaaggacccaatgtgggaagctttggctaagaagatgggtttggaagaaagagaagctgtttacgaaccaatctttgctatcaacgaaagagatgacttgactccagaagctaacgaagtttacttgggtgaaccaaataaattgcacttggaaggtactgctaagggtcctttcaactctcacaacccatacattgctccaattgctgaatcttacgaattgttctctgccaaggacagaaactgtttgcacatggaaattgatatctctggttccaacttgaaatacgaaactggtgaccacattgccatctggccaaccaacccaggtgaagaagtcaacaaattcttggatatcttggacttatccggtaagcaacactctgttgttaccgttaaggccttggaaccaactgccaaggtcccattcccaaacccaaccacttacgatgctatcctaagataccacttggaaatctgtgccccagtttcccgtcaatttgtctctactttggctgcctttgctccaaacgacgacatcaaggctgaaatgaacagattgggttctgacaaggactacttccatgaaaagactggtccacactactacaacattgccagattcttagcttccgtttctaagggtgaaaagtggaccaagattccattttccgctttcatcgaaggtttgaccaaattacaaccaagatactactccatctcctcttcttctttggtccaaccaaagaagatctccatcactgccgtcgttgaatctcaacaaattccaggtagagatgacccattcagaggtgtcgccaccaactacttgttcgctttgaagcaaaagcaaaacggtgacccaaacccagctccattcggtcaatcttacgaattgaccggtccaagaaacaaatacgatggtattcatgttccagtccacgtcagacactccaactttaaattgccttctgacccaggtaagccaatcatcatgatcggtccaggtactggtgttgctccattcagaggtttcgttcaagaaagagccaagcaagctagagatggtgtcgaagtcggtaagactttgttattcttcggttgtcgtaaatctactgaagatttcatgtaccaaaaggaatggcaagaatacaaagaagctttgggtgacaagttcgaaatgatcactgctttctccagagaaggttccaagaaggtttacgtccaacatcgtttgaaggaaagatccaaggaagtttccgacttgttgtctcaaaaggcctacttctacgtttgtggtgacgctgctcacatggctcgtgaagtcaacaccgtcttggctcaaatcattgctgaaggtagaggtgtctctgaagctaagggtgaagaaattgtcaagaacatgagatctgccaaccaataccaagtttgttctgatttcgttactttacactgtaaggaaaccacctacgctaactctgaattgcaagaagatgtctggtct

SEQ ID NO: 54 - protein, 713 aa, Gibberella fujikuroi
MAELDTLDIVVLGVIFLGTVAYFTKGKLWGVTKDPYANGFAAGGASKPGRTRNIVEAMEESGKNCVVFYGSQTGTAEDYASRLAKEGKSRFGLNTMIADLEDYDFDNLDTVPSDNIVMFVLATYGEGEPTDNAVDFYEFITGEDASFNEGNDPPLGNLNYVAFGLGNNTYEHYNSMVRNVNKALEKLGAHRIGEAGEGDDGAGTMEEDFLAWKDPMWEALAKKMGLEEREAVYEPIFAINERDDLTPEANEVYLGEPNKLHLEGTAKGPFNSHNPYIAPIAESYELFSAKDRNCLHMEIDISGSNLKYETGDHIAIWPTNPGEEVNKFLDILDLSGKQHSVVTVKALEPTAKVPFPNPTTYDAILRYHLEICAPVSRQFVSTLAAFAPNDDIKAEMNRLGSDKDYFHEKTGPHYYNIARFLASVSKGEKWTKIPFSAFIEGLTKLQPRYYSISSSSLVQPKKISITAVVESQQIPGRDDPFRGVATNYLFALKQKQNGDPNPAPFGQSYELTGPRNKYDGIHVPVHVRHSNFKLPSDPGKPIIMIGPGTGVAPFRGFVQERAKQARDGVEVGKTLLFFGCRKSTEDFMYQKEWQEYKEALGDKFEMITAFSREGSKKVYVQHRLKERSKEVSDLLSQKAYFYVCGDAAHMAREVNTVLAQIIAEGRGVSEAKGEEIVKNMRSANQYQVCSDFVTLHCKETTYANSELQEDVWS

SEQ ID NO: 55 - DNA, 2076 bp, Arabidopsis thaliana
  CDS (1)..(2076)
atgacctctgctttatacgcctccgatttgttcaagcaattgaagtccatcatgggtactgactctttgtccgatgatgttgtcttagtcattgccaccacttctttggctttggttgctggtttcgttgtcttgttgtggaagaaaaccaccgctgacagatccggtgaattgaaacctttgatgattccaaagtctttgatggccaaggacgaagatgacgacttggacttgggttctggtaagaccagagtctccattttcttcggtactcaaaccggtactgctgaaggtttcgctaaggctttgtctgaagaaattaaagccagatacgaaaaggctgccgttaaggttatcgatttggatgactacgctgctgacgatgaccaatacgaagaaaagttgaagaaggaaactttggctttcttctgtgttgctacctacggtgacggtgaaccaactgacaatgctgctagattctacaagtggttcaccgaagaaaacgaaagagacatcaaattgcaacaattggcttacggtgtctttgctttgggtaacagacaatacgaacatttcaacaagatcggtattgtcttggacgaagaattatgtaagaagggtgccaagagattgattgaagtcggtttgggtgacgatgaccaatctattgaagatgacttcaacgcttggaaggaatctttgtggtctgaattagacaagttattgaaggacgaagatgacaagtccgttgctactccatacactgctgtcatcccagaataccgtgtcgtcacccacgacccaagattcaccacccaaaagtccatggaatccaacgttgccaacggtaacaccactattgacatccaccacccatgtcgtgttgatgttgctgttcaaaaggaattgcacacccacgaatctgaccgttcttgtattcacttggaattcgatatctccagaaccggtatcacttacgaaactggtgaccacgtcggtgtctacgctgaaaaccacgttgaaatcgtcgaagaagccggtaaattgttgggtcactctttggacttggttttctccatccacgctgacaaggaagatggttctccattagaatccgccgtcccacctccattcccaggtccatgtaccttaggtactggtctagctcgttacgctgatttgttgaacccaccaagaaagtctgctttggttgctttggctgcttacgctactgaaccttctgaagctgaaaagttgaagcatttgacttctccagacggtaaggatgaatactcccaatggatcgttgcttctcaaagatctctattggaagttatggctgctttcccatctgccaagccaccattgggtgttttctttgctgccattgctccaagattgcaaccaagatactactccatttcttcttctccaagattggctccatctagagtccacgtcacctctgctttggtttacggtccaactccaaccggtagaatccacaaaggtgtttgttccacctggatgaagaacgctgttccagctgaaaagtcccacgaatgttccggtgctccaatctttatcagagcttctaacttcaagttgccatccaacccatctactccaatcgtcatggttggtccaggtactggtttggctccattcagaggtttcttacaagaaagaatggctttgaaagaagatggtgaagaattgggttcttctctattgttcttcggttgtagaaacagacaaatggacttcatctacgaagatgaattaaacaactttgtcgaccaaggtgttatctccgaattgatcatggccttctctagagaaggtgctcaaaaggaatacgttcaacataaaatgatggaaaaggctgctcaagtttgggacttgatcaaggaagaaggttacttgtacgtttgtggtgatgccaaaggtatggccagagatgtccacagaactttgcacaccattgtccaagaacaagaaggtgtttcctcttccgaagctgaagccattgtcaagaagttacaaactgaaggtcgttatttgagagatgtctgg

SEQ ID NO: 56 - protein, 692 aa, Arabidopsis thaliana [sequence omitted]

SEQ ID NO: 57 - DNA, 2133 bp, Arabidopsis thaliana
  CDS (1)..(2133)
atgtcctcttcttcttcttcttctacttccatgattgatttgatggctgccatcatcaagggtgaaccagtcattgtctctgacccagccaacgcttctgcttacgaatccgttgctgctgaattgtcctccatgttgattgaaaacagacaattcgctatgattgtcactacttccattgctgtcttgattggttgtatcgtcatgttggtctggagaagatccggttccggtaactccaagagagttgaaccattgaagccattagtcatcaagccaagagaagaagaaattgatgacggtagaaagaaggtcaccatcttctttggtactcaaaccggtactgctgaaggttttgctaaggctttgggtgaagaagccaaagctagatacgaaaagaccagattcaagatcgttgacttggacgactacgctgctgatgacgacgaatacgaagaaaagttgaagaaggaagatgttgccttcttcttcttggctacttacggtgatggtgaaccaactgacaatgctgccagattctacaaatggttcaccgaaggtaacgacagaggtgaatggttaaagaacttgaaatacggtgttttcggtctaggtaacagacaatacgaacacttcaacaaggttgccaaggttgtcgatgacatcttggttgaacaaggtgctcaaagattagtccaagtcggtttgggtgatgatgaccaatgtatcgaagatgacttcactgcttggagagaagctttgtggccagaattggacaccatcttaagagaagaaggtgataccgctgttgccaccccatacactgctgctgttttggaatacagagtttctatccacgactctgaagatgccaagttcaacgacatcaacatggctaacggtaacggttacactgttttcgacgctcaacacccatacaaggccaatgttgctgtcaagagagaattgcacactccagaatctgatcgttcttgtatccacttggaatttgacattgctggttctggtttgacctacgaaaccggtgaccacgtcggtgtcttatgtgacaacttgtctgaaactgtcgatgaagctttgagattattggacatgtctccagacacttatttctccttgcatgctgaaaaggaagatggtactccaatttcttcttccttgcctcctccattcccaccatgtaacttgagaaccgctttaaccagatacgcttgtttgctatcctctccaaagaagtccgctttggttgctttggctgctcacgcttctgacccaactgaagctgaaagattgaaacatttggcttccccagctggtaaggatgaatactccaaatgggttgttgaatctcaaagatctttgttggaagtcatggctgaattcccatctgccaagccaccattgggtgttttcttcgccggtgttgctccaagattgcaaccaagattttactccatctcttcttctccaaagattgctgaaaccagaattcacgttacctgtgccttggtctacgaaaagatgccaaccggtagaattcacaagggtgtttgttccacctggatgaagaacgctgttccatacgaaaagtctgaaaactgttcttctgctccaatcttcgtccgtcaatccaacttcaagttgccatctgactccaaggtcccaatcatcatgatcggtccaggtactggtttagctccattcagaggtttcttgcaagaaagattggccttagttgaatctggtgtcgaattgggtccttctgttttgttcttcggttgtagaaaccgtcgtatggacttcatctacgaagaagaattgcaaagatttgtcgaatctggtgctttggctgaattgtccgttgctttctctcgtgaaggtccaaccaaagaatacgttcaacacaagatgatggacaaagcctccgacatctggaacatgatctcccaaggtgcttacttgtacgtttgtggtgatgctaaaggtatggccagagatgtccacagatctttacataccattgcccaagaacaaggttccatggactccaccaaggctgaaggtttcgttaagaacttgcaaacttctggtcgttacttgagagatgtttgg

SEQ ID NO: 58 - protein, 711 aa, Arabidopsis thaliana
MSSSSSSSTSMIDLMAAIIKGEPVIVSDPANASAYESVAAELSSMLIENRQFAMIVTTSIAVLIGCIVMLVWRRSGSGNSKRVEPLKPLVIKPREEEIDDGRKKVTIFFGTQTGTAEGFAKALGEEAKARYEKTRFKIVDLDDYAADDDEYEEKLKKEDVAFFFLATYGDGEPTDNAARFYKWFTEGNDRGEWLKNLKYGVFGLGNRQYEHFNKVAKVVDDILVEQGAQRLVQVGLGDDDQCIEDDFTAWREALWPELDTILREEGDTAVATPYTAAVLEYRVSIHDSEDAKFNDINMANGNGYTVFDAQHPYKANVAVKRELHTPESDRSCIHLEFDIAGSGLTYETGDHVGVLCDNLSETVDEALRLLDMSPDTYFSLHAEKEDGTPISSSLPPPFPPCNLRTALTRYACLLSSPKKSALVALAAHASDPTEAERLKHLASPAGKDEYSKWVVESQRSLLEVMAEFPSAKPPLGVFFAGVAPRLQPRFYSISSSPKIAETRIHVTCALVYEKMPTGRIHKGVCSTWMKNAVPYEKSENCSSAPIFVRQSNFKLPSDSKVPIIMIGPGTGLAPFRGFLQERLALVESGVELGPSVLFFGCRNRRMDFIYEEELQRFVESGALAELSVAFSREGPTKEYVQHKMMDKASDIWNMISQGAYLYVCGDAKGMARDVHRSLHTIAQEQGSMDSTKAEGFVKNLQTSGRYLRDVW

SEQ ID NO: 59 - DNA, 2361 bp, Stevia rebaudiana
  CDS (1)..(2361)
atgaagactggtttcatctctccagctaccgtcttccaccacagaatctctccagctaccactttcagacaccacttgtccccagctaccactaactctactggtattgttgctttgagagacatcaacttcagatgtaaagctgtttccaaggaatactctgacttgttgcaaaaggatgaagcctccttcaccaaatgggatgatgacaaagttaaggaccatttagacactaacaagaacttgtacccaaacgatgaaatcaaggaattcgtcgaatctgtcaaagctatgttcggttccatgaatgatggtgaaatcaacgtttccgcttacgacaccgcttgggttgctttggttcaagacgttgatggttccggttctccacaattcccatcttctttggaatggattgccaacaaccaattgtctgatggttcttggggtgaccatttgttattctctgctcacgacagaattattaacactttagcttgtgtcattgctttgacttcctggaatgtccatccatccaagtgtgaaaagggtttgaacttcttgagagaaaacatctgtaagttggaagatgaaaatgctgaacacatgccaattggtttcgaagttaccttcccatctttgattgatatcgccaagaagttgaacatcgaagtcccagaagacaccccagctttgaaggaaatctacgccagaagagatatcaagttgaccaaaatcccaatggaagttttgcacaaggttccaaccaccttgttgcactctttggaaggtatgccagacttggaatgggaaaagttgttaaagttgcaatgtaaggacggttctttcttgttctctccatcttctaccgcctttgctttgatgcaaactaaggacgaaaagtgtctacaatacttaactaatatcgttaccaaattcaacggtggtgtcccaaacgtttaccctgttgacttgtttgaacacatctgggttgttgacagattgcaacgtttgggtattgctcgttatttcaagtctgaaatcaaggactgtgttgaatacatcaacaagtactggactaagaacggtatctgttgggctcgtaacacccacgttcaagatatcgacgacactgctatgggtttcagagtcttgagagctcatggttacgatgtcaccccagatgtcttcagacaattcgaaaaggatggtaagttcgtttgttttgccggtcaatccactcaagccgtcactggtatgttcaacgtctacagagcttctcaaatgttgttcccaggtgaaagaatcctagaagacgctaagaagttctcctacaactacttgaaagaaaagcaatctactaacgaattgttggacaaatggatcattgccaaagacttaccaggtgaagtcggttacgctttggatattccatggtacgcttctctaccaagattagaaaccagatactacttggaacaatacggtggtgaagacgatgtctggatcggtaagaccttgtacagaatgggttacgtttccaacaacacttacttggaaatggccaaattggactacaacaactacgtcgccgtcttacaattggaatggtacaccattcaacaatggtacgttgacattggtattgaaaagtttgaatccgacaacatcaagtccgtcttggtttcctactacttggctgctgcttccatctttgaaccagaaagatccaaggaaagaattgcttgggctaagaccaccatcttggttgacaagatcacttctattttcgactcttcccaatcttccaaggaagatatcaccgctttcattgacaaattcagaaacaagtcttcttccaagaagcactccattaacggtgaaccatggcacgaagttatggttgctttgaagaagactttgcacggttttgctttggatgctttgatgactcactctcaagatattcaccctcaattacaccaagcttgggaaatgtggttaaccaagttgcaagatggtgtcgatgtcactgctgaattgatggttcaaatgatcaacatgactgccggtagatgggtttctaaggaattgttgactcaccctcaataccaacgtttgtccaccgtcaccaactctgtctgtcacgacatcactaagttgcacaacttcaaagaaaactccactactgtcgattctaaggttcaagaattggttcaattagttttctctgacaccccagatgacttggaccaagacatgaagcaaactttcttgactgtcatgaagaccttctactacaaggcttggtgtgacccaaacaccatcaacgaccatatttctaaggtcttcgaaattgttatc

SEQ ID NO: 60 - protein, 787 aa, Stevia rebaudiana
MKTGFISPATVFHHRISPATTFRHHLSPATTNSTGIVALRDINFRCKAVSKEYSDLLQKDEASFTKWDDDKVKDHLDTNKNLYPNDEIKEFVESVKAMFGSMNDGEINVSAYDTAWVALVQDVDGSGSPQFPSSLEWIANNQLSDGSWGDHLLFSAHDRIINTLACVIALTSWNVHPSKCEKGLNFLRENICKLEDENAEHMPIGFEVTFPSLIDIAKKLNIEVPEDTPALKEIYARRDIKLTKIPMEVLHKVPTTLLHSLEGMPDLEWEKLLKLQCKDGSFLFSPSSTAFALMQTKDEKCLQYLTNIVTKFNGGVPNVYPVDLFEHIWVVDRLQRLGIARYFKSEIKDCVEYINKYWTKNGICWARNTHVQDIDDTAMGFRVLRAHGYDVTPDVFRQFEKDGKFVCFAGQSTQAVTGMFNVYRASQMLFPGERILEDAKKFSYNYLKEKQSTNELLDKWIIAKDLPGEVGYALDIPWYASLPRLETRYYLEQYGGEDDVWIGKTLYRMGYVSNNTYLEMAKLDYNNYVAVLQLEWYTIQQWYVDIGIEKFESDNIKSVLVSYYLAAASIFEPERSKERIAWAKTTILVDKITSIFDSSQSSKEDITAFIDKFRNKSSSKKHSINGEPWHEVMVALKKTLHGFALDALMTHSQDIHPQLHQAWEMWLTKLQDGVDVTAELMVQMINMTAGRWVSKELLTHPQYQRLSTVTNSVCHDITKLHNFKENSTTVDSKVQELVQLVFSDTPDDLDQDMKQTFLTVMKTFYYKAWCDPNTINDHISKVFEIVI

SEQ ID NO: 61 - DNA, 2229 bp, Stevia rebaudiana
  CDS (1)..(2229)
atgtgtaaagctgtttccaaggaatactctgacttgttgcaaaaggatgaagcctccttcaccaaatgggatgatgacaaagttaaggaccatttagacactaacaagaacttgtacccaaacgatgaaatcaaggaattcgtcgaatctgtcaaagctatgttcggttccatgaatgatggtgaaatcaacgtttccgcttacgacaccgcttgggttgctttggttcaagacgttgatggttccggttctccacaattcccatcttctttggaatggattgccaacaaccaattgtctgatggttcttggggtgaccatttgttattctctgctcacgacagaattattaacactttagcttgtgtcattgctttgacttcctggaatgtccatccatccaagtgtgaaaagggtttgaacttcttgagagaaaacatctgtaagttggaagatgaaaatgctgaacacatgccaattggtttcgaagttaccttcccatctttgattgatatcgccaagaagttgaacatcgaagtcccagaagacaccccagctttgaaggaaatctacgccagaagagatatcaagttgaccaaaatcccaatggaagttttgcacaaggttccaaccaccttgttgcactctttggaaggtatgccagacttggaatgggaaaagttgttaaagttgcaatgtaaggacggttctttcttgttctctccatcttctaccgcctttgctttgatgcaaactaaggacgaaaagtgtctacaatacttaactaatatcgttaccaaattcaacggtggtgtcccaaacgtttaccctgttgacttgtttgaacacatctgggttgttgacagattgcaacgtttgggtattgctcgttatttcaagtctgaaatcaaggactgtgttgaatacatcaacaagtactggactaagaacggtatctgttgggctcgtaacacccacgttcaagatatcgacgacactgctatgggtttcagagtcttgagagctcatggttacgatgtcaccccagatgtcttcagacaattcgaaaaggatggtaagttcgtttgttttgccggtcaatccactcaagccgtcactggtatgttcaacgtctacagagcttctcaaatgttgttcccaggtgaaagaatcctagaagacgctaagaagttctcctacaactacttgaaagaaaagcaatctactaacgaattgttggacaaatggatcattgccaaagacttaccaggtgaagtcggttacgctttggatattccatggtacgcttctctaccaagattagaaaccagatactacttggaacaatacggtggtgaagacgatgtctggatcggtaagaccttgtacagaatgggttacgtttccaacaacacttacttggaaatggccaaattggactacaacaactacgtcgccgtcttacaattggaatggtacaccattcaacaatggtacgttgacattggtattgaaaagtttgaatccgacaacatcaagtccgtcttggtttcctactacttggctgctgcttccatctttgaaccagaaagatccaaggaaagaattgcttgggctaagaccaccatcttggttgacaagatcacttctattttcgactcttcccaatcttccaaggaagatatcaccgctttcattgacaaattcagaaacaagtcttcttccaagaagcactccattaacggtgaaccatggcacgaagttatggttgctttgaagaagactttgcacggttttgctttggatgctttgatgactcactctcaagatattcaccctcaattacaccaagcttgggaaatgtggttaaccaagttgcaagatggtgtcgatgtcactgctgaattgatggttcaaatgatcaacatgactgccggtagatgggtttctaaggaattgttgactcaccctcaataccaacgtttgtccaccgtcaccaactctgtctgtcacgacatcactaagttgcacaacttcaaagaaaactccactactgtcgattctaaggttcaagaattggttcaattagttttctctgacaccccagatgacttggaccaagacatgaagcaaactttcttgactgtcatgaagaccttctactacaaggcttggtgtgacccaaacaccatcaacgaccatatttctaaggtcttcgaaattgttatc

SEQ ID NO: 62 - protein, 743 aa, Stevia rebaudiana
MCKAVSKEYSDLLQKDEASFTKWDDDKVKDHLDTNKNLYPNDEIKEFVESVKAMFGSMNDGEINVSAYDTAWVALVQDVDGSGSPQFPSSLEWIANNQLSDGSWGDHLLFSAHDRIINTLACVIALTSWNVHPSKCEKGLNFLRENICKLEDENAEHMPIGFEVTFPSLIDIAKKLNIEVPEDTPALKEIYARRDIKLTKIPMEVLHKVPTTLLHSLEGMPDLEWEKLLKLQCKDGSFLFSPSSTAFALMQTKDEKCLQYLTNIVTKFNGGVPNVYPVDLFEHIWVVDRLQRLGIARYFKSEIKDCVEYINKYWTKNGICWARNTHVQDIDDTAMGFRVLRAHGYDVTPDVFRQFEKDGKFVCFAGQSTQAVTGMFNVYRASQMLFPGERILEDAKKFSYNYLKEKQSTNELLDKWIIAKDLPGEVGYALDIPWYASLPRLETRYYLEQYGGEDDVWIGKTLYRMGYVSNNTYLEMAKLDYNNYVAVLQLEWYTIQQWYVDIGIEKFESDNIKSVLVSYYLAAASIFEPERSKERIAWAKTTILVDKITSIFDSSQSSKEDITAFIDKFRNKSSSKKHSINGEPWHEVMVALKKTLHGFALDALMTHSQDIHPQLHQAWEMWLTKLQDGVDVTAELMVQMINMTAGRWVSKELLTHPQYQRLSTVTNSVCHDITKLHNFKENSTTVDSKVQELVQLVFSDTPDDLDQDMKQTFLTVMKTFYYKAWCDPNTINDHISKVFEIVI

SEQ ID NO: 63 - DNA, 2352 bp, Stevia rebaudiana
  CDS (1)..(2352)
atgaacttgtctctatgtattgcttctccattattgaccaaatctaacagaccagccgctctatccgctattcacactgcctccacttctcacggtggtcaaaccaacccaaccaacttgattattgacaccaccaaggaaagaatccaaaagcaattcaagaatgttgaaatctccgtttcctcctacgacactgcttgggttgccatggttccatctccaaactccccaaagtctccatgtttcccagaatgtttgaactggttaatcaacaaccaattgaacgatggttcctggggtttagtcaatcacacccacaaccacaatcacccattgttgaaggactctctatcctccactttggcttgtatcgttgctttgaagagatggaacgttggtgaagaccaaatcaacaagggtttgtcctttattgaatccaacttggcttctgctactgaaaagtcccaaccatctcctatcggttttgacatcattttcccaggtttattggaatacgctaagaacttggacatcaacttattatctaagcaaaccgatttctccttgatgttgcacaagagagaattggaacaaaagagatgtcactccaacgaaatggacggttacttggcttacatttctgaaggtttgggtaacttgtacgactggaacatggtcaagaaataccaaatgaagaacggttccgttttcaactctccatctgctaccgctgctgctttcatcaaccatcaaaacccaggttgtttgaactacttgaactctttgttggacaaattcggtaacgctgttccaactgtctacccacacgatttgtttatcagattatccatggttgacaccattgaacgtttgggtatttctcatcacttcagagtcgaaatcaagaacgttttggatgaaacttacagatgttgggttgaaagagatgaacaaatcttcatggatgtcgtcacttgtgccttggccttcagattattgagaattaacggttacgaagtttctccagacccattggctgaaatcactaacgaattggctttgaaggacgaatacgccgctttggaaacttaccatgcctctcacatcttataccaagaagacttgtcctctggtaagcaaatcttgaagtctgctgacttcttgaaggaaattatctctactgattctaacagattgtccaagttgattcacaaggaagttgaaaacgccttgaaattcccaatcaacactggtttggaaagaattaacaccagaagaaacatccaattatacaacgttgacaacactagaatcttgaagactacttatcactcttccaacatctccaacactgactacttgagattggctgtcgaagatttctacacctgtcaatctatttacagagaagaattgaagggtttggaaagatgggttgtcgaaaacaaattggaccaattgaaatttgctagacaaaagaccgcctactgttacttctccgttgctgccactttgtcctctccagaattatctgacgccagaatctcctgggctaagaatggtatcttgaccaccgttgtcgatgacttcttcgatattggtggtaccattgacgaattgaccaacttgattcaatgtgttgaaaagtggaacgtcgatgtcgataaggactgttgttctgaacacgtcagaatcttattcttggctttgaaagatgctatctgttggatcggtgacgaagctttcaaatggcaagctcgtgacgttacctctcacgtcatccaaacctggttggaattgatgaactctatgttgagagaagccatctggacccgtgatgcttacgtcccaactttgaacgaatacatggaaaatgcttacgtttctttcgctttgggtccaattgtcaagcctgctatttacttcgttggtccaaagttgtccgaagaaattgttgaatcttctgaataccacaacttgttcaaattgatgtctactcaaggtcgtttgttgaacgatatccactctttcaagcgtgaattcaaggaaggtaagttgaatgctgttgctttgcatttgtctaacggtgaatctggtaaggtcgaagaagaagttgtcgaagaaatgatgatgatgatcaagaacaagagaaaggaattgatgaagttgatctttgaagaaaacggttctattgtcccaagagcttgtaaggatgctttctggaacatgtgtcacgtcttgaacttcttctacgctaacgatgacggtttcactggtaacaccatcttagacaccgtcaaggacatcatttacaacccattagtcttggttaacgaaaacgaagaacaaaga

SEQ ID NO: 64 - protein, 784 aa, Stevia rebaudiana
MNLSLCIASPLLTKSNRPAALSAIHTASTSHGGQTNPTNLIIDTTKERIQKQFKNVEISVSSYDTAWVAMVPSPNSPKSPCFPECLNWLINNQLNDGSWGLVNHTHNHNHPLLKDSLSSTLACIVALKRWNVGEDQINKGLSFIESNLASATEKSQPSPIGFDIIFPGLLEYAKNLDINLLSKQTDFSLMLHKRELEQKRCHSNEMDGYLAYISEGLGNLYDWNMVKKYQMKNGSVFNSPSATAAAFINHQNPGCLNYLNSLLDKFGNAVPTVYPHDLFIRLSMVDTIERLGISHHFRVEIKNVLDETYRCWVERDEQIFMDVVTCALAFRLLRINGYEVSPDPLAEITNELALKDEYAALETYHASHILYQEDLSSGKQILKSADFLKEIISTDSNRLSKLIHKEVENALKFPINTGLERINTRRNIQLYNVDNTRILKTTYHSSNISNTDYLRLAVEDFYTCQSIYREELKGLERWVVENKLDQLKFARQKTAYCYFSVAATLSSPELSDARISWAKNGILTTVVDDFFDIGGTIDELTNLIQCVEKWNVDVDKDCCSEHVRILFLALKDAICWIGDEAFKWQARDVTSHVIQTWLELMNSMLREAIWTRDAYVPTLNEYMENAYVSFALGPIVKPAIYFVGPKLSEEIVESSEYHNLFKLMSTQGRLLNDIHSFKREFKEGKLNAVALHLSNGESGKVEEEVVEEMMMMIKNKRKELMKLIFEENGSIVPRACKDAFWNMCHVLNFFYANDDGFTGNTILDTVKDIIYNPLVLVNENEEQR

SEQ ID NO: 65 - DNA, 2271 bp, Stevia rebaudiana
  CDS (1)..(2271)
atgacttctcacggtggtcaaaccaacccaaccaacttgattattgacaccaccaaggaaagaatccaaaagcaattcaagaatgttgaaatctccgtttcctcctacgacactgcttgggttgccatggttccatctccaaactccccaaagtctccatgtttcccagaatgtttgaactggttaatcaacaaccaattgaacgatggttcctggggtttagtcaatcacacccacaaccacaatcacccattgttgaaggactctctatcctccactttggcttgtatcgttgctttgaagagatggaacgttggtgaagaccaaatcaacaagggtttgtcctttattgaatccaacttggcttctgctactgaaaagtcccaaccatctcctatcggttttgacatcattttcccaggtttattggaatacgctaagaacttggacatcaacttattatctaagcaaaccgatttctccttgatgttgcacaagagagaattggaacaaaagagatgtcactccaacgaaatggacggttacttggcttacatttctgaaggtttgggtaacttgtacgactggaacatggtcaagaaataccaaatgaagaacggttccgttttcaactctccatctgctaccgctgctgctttcatcaaccatcaaaacccaggttgtttgaactacttgaactctttgttggacaaattcggtaacgctgttccaactgtctacccacacgatttgtttatcagattatccatggttgacaccattgaacgtttgggtatttctcatcacttcagagtcgaaatcaagaacgttttggatgaaacttacagatgttgggttgaaagagatgaacaaatcttcatggatgtcgtcacttgtgccttggccttcagattattgagaattaacggttacgaagtttctccagacccattggctgaaatcactaacgaattggctttgaaggacgaatacgccgctttggaaacttaccatgcctctcacatcttataccaagaagacttgtcctctggtaagcaaatcttgaagtctgctgacttcttgaaggaaattatctctactgattctaacagattgtccaagttgattcacaaggaagttgaaaacgccttgaaattcccaatcaacactggtttggaaagaattaacaccagaagaaacatccaattatacaacgttgacaacactagaatcttgaagactacttatcactcttccaacatctccaacactgactacttgagattggctgtcgaagatttctacacctgtcaatctatttacagagaagaattgaagggtttggaaagatgggttgtcgaaaacaaattggaccaattgaaatttgctagacaaaagaccgcctactgttacttctccgttgctgccactttgtcctctccagaattatctgacgccagaatctcctgggctaagaatggtatcttgaccaccgttgtcgatgacttcttcgatattggtggtaccattgacgaattgaccaacttgattcaatgtgttgaaaagtggaacgtcgatgtcgataaggactgttgttctgaacacgtcagaatcttattcttggctttgaaagatgctatctgttggatcggtgacgaagctttcaaatggcaagctcgtgacgttacctctcacgtcatccaaacctggttggaattgatgaactctatgttgagagaagccatctggacccgtgatgcttacgtcccaactttgaacgaatacatggaaaatgcttacgtttctttcgctttgggtccaattgtcaagcctgctatttacttcgttggtccaaagttgtccgaagaaattgttgaatcttctgaataccacaacttgttcaaattgatgtctactcaaggtcgtttgttgaacgatatccactctttcaagcgtgaattcaaggaaggtaagttgaatgctgttgctttgcatttgtctaacggtgaatctggtaaggtcgaagaagaagttgtcgaagaaatgatgatgatgatcaagaacaagagaaaggaattgatgaagttgatctttgaagaaaacggttctattgtcccaagagcttgtaaggatgctttctggaacatgtgtcacgtcttgaacttcttctacgctaacgatgacggtttcactggtaacaccatcttagacaccgtcaaggacatcatttacaacccattagtcttggttaacgaaaacgaagaacaaaga

SEQ ID NO: 66 - protein, 757 aa, Stevia rebaudiana
MTSHGGQTNPTNLIIDTTKERIQKQFKNVEISVSSYDTAWVAMVPSPNSPKSPCFPECLNWLINNQLNDGSWGLVNHTHNHNHPLLKDSLSSTLACIVALKRWNVGEDQINKGLSFIESNLASATEKSQPSPIGFDIIFPGLLEYAKNLDINLLSKQTDFSLMLHKRELEQKRCHSNEMDGYLAYISEGLGNLYDWNMVKKYQMKNGSVFNSPSATAAAFINHQNPGCLNYLNSLLDKFGNAVPTVYPHDLFIRLSMVDTIERLGISHHFRVEIKNVLDETYRCWVERDEQIFMDVVTCALAFRLLRINGYEVSPDPLAEITNELALKDEYAALETYHASHILYQEDLSSGKQILKSADFLKEIISTDSNRLSKLIHKEVENALKFPINTGLERINTRRNIQLYNVDNTRILKTTYHSSNISNTDYLRLAVEDFYTCQSIYREELKGLERWVVENKLDQLKFARQKTAYCYFSVAATLSSPELSDARISWAKNGILTTVVDDFFDIGGTIDELTNLIQCVEKWNVDVDKDCCSEHVRILFLALKDAICWIGDEAFKWQARDVTSHVIQTWLELMNSMLREAIWTRDAYVPTLNEYMENAYVSFALGPIVKPAIYFVGPKLSEEIVESSEYHNLFKLMSTQGRLLNDIHSFKREFKEGKLNAVALHLSNGESGKVEEEVVEEMMMMIKNKRKELMKLIFEENGSIVPRACKDAFWNMCHVLNFFYANDDGFTGNTILDTVKDIIYNPLVLVNENEEQR

SEQ ID NO: 67 - DNA, 1539 bp, Stevia rebaudiana
  CDS (1)..(1539)
atggatgctgtcactggtttgttgaccgtcccagctaccgccatcaccattggtggtactgctgttgctttggctgttgctttgatcttctggtacttgaaatcttacacttctgccagaagatctcaatctaaccatttaccaagagttccagaagttccaggtgttccattgttgggtaacttgttgcaattgaaagaaaagaagccttacatgactttcaccagatgggctgctacctacggtccaatttactctatcaagaccggtgctacctccatggttgttgtttcctccaacgaaattgccaaggaagctttagtcaccagattccaatccatctctaccagaaacttgtccaaggctttgaaggtcttgactgctgacaagaccatggttgccatgtctgactacgatgactaccacaagactgtcaaacgtcacatcttgactgctgttttgggtccaaatgctcaaaagaagcacagaattcacagagatatcatgatggacaacatctctactcaattgcatgaatttgtcaagaacaacccagaacaagaagaagtcgatttgagaaagatcttccaatctgaattgttcggtttggccatgagacaagctttgggtaaagatgtcgaatctttatacgtcgaagatttgaagatcaccatgaacagagatgaaatcttccaagttttggttgtcgacccaatgatgggtgccattgatgttgactggagagatttcttcccatacttgaaatgggttccaaacaagaagttcgaaaataccattcaacaaatgtacatccgtcgtgaagctgtcatgaagtctttaatcaaggaaaacaagaagagaattgcttctggtgaaaagttaaactcctacattgactatttgttgtccgaagctcaaactttgactgaccaacaattattgatgtctttatgggaaccaatcattgaatcttctgacaccaccatggtcactactgaatgggctatgtacgaattggccaagaacccaaaattacaagaccgtttgtacagagatatcaaatccgtctgtggttccgaaaagatcactgaagaacacttgtctcaattgccatacatcactgctatcttccacgaaactttgagaagacactctccagttccaatcattccattgagacacgtccacgaagacactgttttgggtggttaccacgttccagctggtactgaattggctgtcaacatctacggttgtaacatggacaagaacgtctgggaaaacccagaagaatggaacccagaaagattcatgaaggaaaacgaaaccattgacttccaaaagaccatggctttcggtggtggtaagagagtttgtgccggttccttgcaagctctattgaccgcttccattggtattggtagaatggttcaagaatttgaatggaagttgaaggacatgacccaagaagaagttaacaccattggtttgactactcaaatgttaagaccattgagagccatcatcaagcctcgcatc

SEQ ID NO: 68 - protein, 513 aa, Stevia rebaudiana
MDAVTGLLTVPATAITIGGTAVALAVALIFWYLKSYTSARRSQSNHLPRVPEVPGVPLLGNLLQLKEKKPYMTFTRWAATYGPIYSIKTGATSMVVVSSNEIAKEALVTRFQSISTRNLSKALKVLTADKTMVAMSDYDDYHKTVKRHILTAVLGPNAQKKHRIHRDIMMDNISTQLHEFVKNNPEQEEVDLRKIFQSELFGLAMRQALGKDVESLYVEDLKITMNRDEIFQVLVVDPMMGAIDVDWRDFFPYLKWVPNKKFENTIQQMYIRREAVMKSLIKENKKRIASGEKLNSYIDYLLSEAQTLTDQQLLMSLWEPIIESSDTTMVTTEWAMYELAKNPKLQDRLYRDIKSVCGSEKITEEHLSQLPYITAIFHETLRRHSPVPIIPLRHVHEDTVLGGYHVPAGTELAVNIYGCNMDKNVWENPEEWNPERFMKENETIDFQKTMAFGGGKRVCAGSLQALLTASIGIGRMVQEFEWKLKDMTQEEVNTIGLTTQMLRPLRAIIKPRI

SEQ ID NO: 69 - DNA, 1566 bp, Stevia rebaudiana
  CDS (1)..(1566)
atgggtttgttcccattggaagactcttacgctttggttttcgaaggtttggccatcactttggctttgtactacctattgtctttcatctacaagacctccaagaagacctgtaccccaccaaaggcttctggtgaacacccaattaccggtcatttaaacttgttgtctggttcttccggtttgccacacttggctttggcttctttggctgacagatgtggtcctatcttcaccatcagattaggtatcagaagagttttggttgtttccaactgggaaattgccaaggaaatctttaccacccacgacttgattgtctccaacagaccaaagtacttggctgccaagatcttaggtttcaactacgtttctttctctttcgctccatacggtccatactgggttggtatcagaaagattattgctactaaattgatgtcttcttctagattgcaaaagttgcaattcgtccgtgtctttgaattggaaaactccatgaaatccatcagagaatcctggaaggaaaagaaggatgaagaaggtaaggtcttggttgaaatgaagaagtggttctgggaattgaatatgaacattgtcttgagaaccgttgctggtaagcaatacactggtactgttgacgatgctgatgccaagagaatttctgaattgttcagagaatggttccactacactggtagattcgttgtcggtgatgctttcccatttctaggttggttggatttaggtggttacaagaagaccatggaattggttgcctccagattagattccatggtcagcaaatggttggacgaacacagaaagaagcaagctaacgatgacaagaaggaagacatggacttcatggacatcatgatctccatgactgaagctaactctccattggaaggttacggtactgacaccatcatcaagaccacttgtatgactttgattgtttccggtgtcgacaccacttctatcgttttgacctgggctttgtctttgttgttgaacaacagagacactttaaagaaggctcaagaagaattggacatgtgtgtcggtaagggtagacaagtcaatgaatctgatttggtcaacttaatctatttagaagctgtcttgaaagaagctttgagattgtacccagctgctttcttgggtggtcctcgtgctttcttggaagactgtaccgttgccggttacagaattccaaagggtacttgtttgttgatcaacatgtggaaattgcacagagatccaaacatctggtctgacccatgtgaattcaaaccagaaagattcttgactccaaaccaaaaggatgttgatgtcattggtatggacttcgaattgattccattcggtgctggtcgtcgttactgtccaggtaccagattagctttgcaaatgttgcacattgtcttggccactctattacaaaactttgaaatgtccactccaaacgatgctccagttgacatgactgcttccgttggtatgaccaacgccaaggcttctccattggaagttttgttgtctccaagagtcaaatggtct

SEQ ID NO: 70 - protein, 522 aa, Stevia rebaudiana
MGLFPLEDSYALVFEGLAITLALYYLLSFIYKTSKKTCTPPKASGEHPITGHLNLLSGSSGLPHLALASLADRCGPIFTIRLGIRRVLVVSNWEIAKEIFTTHDLIVSNRPKYLAAKILGFNYVSFSFAPYGPYWVGIRKIIATKLMSSSRLQKLQFVRVFELENSMKSIRESWKEKKDEEGKVLVEMKKWFWELNMNIVLRTVAGKQYTGTVDDADAKRISELFREWFHYTGRFVVGDAFPFLGWLDLGGYKKTMELVASRLDSMVSKWLDEHRKKQANDDKKEDMDFMDIMISMTEANSPLEGYGTDTIIKTTCMTLIVSGVDTTSIVLTWALSLLLNNRDTLKKAQEELDMCVGKGRQVNESDLVNLIYLEAVLKEALRLYPAAFLGGPRAFLEDCTVAGYRIPKGTCLLINMWKLHRDPNIWSDPCEFKPERFLTPNQKDVDVIGMDFELIPFGAGRRYCPGTRLALQMLHIVLATLLQNFEMSTPNDAPVDMTASVGMTNAKASPLEVLLSPRVKWS

SEQ ID NO: 71 - DNA, 1443 bp, Stevia rebaudiana
  CDS (1)..(1443)
atggacgctatggccaccactgaaaagaagcctcacgttatctttattccattcccagctcaatctcatatcaaggctatgttgaaattggctcaattattgcaccacaagggtttgcaaatcacttttgtcaacaccgacttcattcacaaccaattcttggaatcttctggtcctcactgtttggacggtgctccaggtttcagattcgaaaccattccagatggtgtttcccactctccagaagcctccatcccaatcagagaatccttgttgagatctattgaaaccaacttcttggaccgtttcatcgatttggttaccaaattgccagacccaccaacctgtatcatttctgacggtttcttgtccgttttcaccatcgatgctgccaagaaattgggtattccagtcatgatgtactggactttggctgcttgtggtttcatgggtttctaccatattcactctttgattgaaaagggtttcgctccattaaaggatgcttcttacttgaccaacggttacttggacaccgtcattgactgggttccaggtatggaaggtatcagattgaaagatttcccattggactggtctactgacttgaatgacaaggtcttgatgttcactactgaagctccacaaagatctcataaggtttctcaccacatcttccacactttcgatgaattagaaccatctatcatcaagactctatccttgagatacaaccatatctacaccattggtccattacaattgttgttggaccaaatcccagaagaaaagaagcaaaccggtatcacttctttgcacggttactctttagtcaaggaagaaccagaatgtttccaatggttacaatccaaggaaccaaactctgttgtctacgttaactttggttccaccactgttatgtccttggaagatatgactgaatttggttggggtttggctaactctaaccactacttcttatggatcatcagatctaacttggtcattggtgaaaacgccgttttgcctccagaattggaagaacacatcaagaagagaggtttcattgcttcctggtgttctcaagaaaaggtcttgaagcacccatctgttggtggtttcttgacccactgtggttggggttccaccattgaatccctatctgctggtgttccaatgatctgttggccatactcctgggaccaattgactaactgtcgttacatctgtaaggaatgggaagttggtttggaaatgggtactaaggtcaagagagatgaagtcaagagattagtccaagaattgatgggtgaaggtggtcacaagatgagaaacaaagccaaggactggaaggaaaaggccagaattgctattgctccaaacggttcttcctccttgaacatcgataaaatggttaaggaaatcactgtcttggctcgaaac

SEQ ID NO: 72 - protein, 481 aa, Stevia rebaudiana
MDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 73 - DNA, 1380 bp, Stevia rebaudiana
  CDS (1)..(1380)
atggctgaacaacaaaagatcaagaaatctccacacgtcttgttgattccattcccattgcaaggtcacatcaacccattcatccaattcggtaagagattgatttccaagggtgtcaagaccactttagtcaccactattcacactttaaactccactttaaaccactctaacactactaccacctctattgaaatccaagccatttctgacggttgtgacgaaggtggtttcatgtctgctggtgaatcttacttggaaactttcaagcaagtcggttccaagtctttggctgatttgatcaagaaattgcaatccgaaggtactaccatcgatgctatcatctacgactccatgactgaatgggttttggatgttgccattgaatttggtattgacggtggttctttcttcacccaagcctgtgttgttaactctttgtactaccacgtccacaagggtttgatctctctaccattaggtgaaaccgtttccgtcccaggtttcccagtcttgcaaagatgggaaactccattgatcttacaaaaccatgaacaaatccaatctccatggtcccaaatgttgtttggtcaattcgctaacattgaccaagctagatgggttttcaccaactctttctacaagttggaagaagaagtcattgaatggaccagaaagatctggaacttgaaggttatcggtccaactctaccatccatgtacttggacaagagattggatgacgacaaggacaacggtttcaacttgtacaaggctaaccatcacgaatgtatgaactggttggatgacaagccaaaggaatctgttgtttacgttgctttcggttctttggtcaagcatggtccagaacaagttgaagaaatcaccagagctttgattgactccgatgttaacttcttatgggttatcaagcacaaggaagaaggtaaattgccagaaaacttgtctgaagttatcaagaccggtaagggtttgattgttgcttggtgtaagcaattggatgttttggctcacgaatccgtcggttgtttcgtcactcactgtggtttcaactctactttggaagctatctccttgggtgttccagttgttgccatgcctcaattctctgaccaaaccaccaacgccaaattgttggatgaaatcttgggtgtcggtgtccgtgtcaaggctgatgaaaacggtattgttagaagaggtaacttagcttcctgtatcaagatgatcatggaagaagaacgtggtgtcattatcagaaagaatgctgtcaaatggaaggacttggctaaggttgctgtccacgaaggtggttcctctgacaatgacattgttgaatttgtctctgaattgatcaaagcg

SEQ ID NO: 74 - protein, 460 aa, Stevia rebaudiana
MAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 75 - DNA, 1374 bp, Stevia rebaudiana
  CDS (1)..(1374)
atggaaaacaagactgaaaccactgttagaagaagaagaagaatcatcttattcccagttccattccaaggtcacattaacccaatcttgcaattggctaacgtcttatactccaagggtttctccatcaccatcttccacaccaacttcaacaaacctaaaacttccaactacccacacttcaccttcagatttatcttggacaacgacccacaagatgaaagaatttctaacttgccaacccatggtccattggccggtatgagaattccaatcatcaacgaacacggtgctgacgaattgagaagagaattggaattgttgatgttggcttctgaagaagatgaagaagtctcttgtttgatcactgatgctttatggtactttgctcaatctgttgctgactctttgaacttgagaagattagtcttgatgacctcttctttgttcaacttccacgctcacgtttctctaccacaatttgatgaattgggttacttggacccagatgacaagaccagattggaagaacaagcctccggtttcccaatgttgaaggtcaaggatatcaagtctgcctactccaactggcaaatcttgaaggaaattttgggtaagatgatcaagcaaaccaaggcttcttctggtgtcatctggaactccttcaaggaattggaagaatctgaattggaaaccgtcatcagagaaattccagctccatctttcttgattccattaccaaagcatttgactgcttcctcctcttctctattggaccacgacagaactgttttccaatggttggaccaacaaccaccatcttccgtcttatacgtttcctttggttccacttctgaagttgacgaaaaggacttcttggaaattgctcgtggtttggttgactccaagcaatctttcttatgggttgtcagaccaggtttcgtcaagggttccacctgggttgaacctttgccagacggtttcttgggtgaaagaggtagaattgtcaaatgggttccacaacaagaagttttggctcacggtgccattggtgctttctggactcactctggttggaactctactttggaatccgtttgtgaaggtgttccaatgattttctctgacttcggtttggaccaaccattgaatgctcgttacatgtccgatgttttgaaggttggtgtctacttggaaaacggttgggaacgtggtgaaattgctaacgccatcagaagagtcatggtcgatgaagaaggtgaatacatcagacaaaatgctcgtgtcttgaaacaaaaggctgatgtttctttgatgaagggtggttcttcttacgaatctttggaatctttggtttcctacatctccagtctc

SEQ ID NO: 76 - protein, 458 aa, Stevia rebaudiana
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 77 - DNA, 2130 bp, Stevia rebaudiana
  CDS (1)..(2130)
atgcaatctgattccgttaaggtttctccattcgacttagtctctgctgccatgaacggtaaggctatggaaaagttgaacgcttctgaatctgaggacccaactactttaccagctttaaagatgttggttgaaaacagagaattgttgactttattcaccacctcctttgctgtcttgattggttgtttggttttcttgatgtggagaagatcttcttctaagaagttggttcaagacccagttcctcaagtcatcgtcgtcaagaagaaggaaaaggaatctgaagtcgatgacggtaagaagaaagtttccatcttctacggtactcaaaccggtactgctgaaggtttcgctaaagctttagttgaagaagctaaggtcagatacgaaaagacctctttcaaggttatcgatttggacgactacgccgctgacgacgacgaatacgaagaaaagttgaagaaggaatctctagctttcttcttcttggctacctacggtgacggtgaaccaaccgacaatgctgccaacttctacaaatggttcaccgaaggtgatgacaagggtgaatggttgaagaaattgcaatacggtgttttcggtttaggtaacagacaatacgaacacttcaacaagattgccatcgtcgttgatgacaaattgactgaaatgggtgccaagagattggttccagtcggtttgggtgatgatgaccaatgtattgaagatgactttaccgcttggaaggaattagtttggccagaattagaccaattgttgagagatgaagatgacacctctgttaccaccccatacaccgccgctgtcttggaataccgtgtcgtttaccatgacaaaccagctgactcttacgctgaagatcaaacccacaccaacggtcacgttgtccacgacgctcaacacccatccagatctaacgttgctttcaagaaggaattgcacacttcccaatctgatcgttcttgtacccacttggaatttgacatctcccacaccggtttgtcttacgaaaccggtgaccatgttggtgtctactctgaaaacttgtctgaagttgtcgacgaagctttgaaattgttgggtttgtctccagacacttacttctccgtccacgctgacaaagaagatggtactccaatcggtggtgcttctttgcctccaccattcccaccatgtactctaagagatgctttgacccgttatgctgacgttctatcctctccaaagaaggttgctttgttggctttggctgctcatgcttctgatccatctgaagctgacagattgaagttcttggcttccccagccggtaaggacgaatacgctcaatggattgttgccaaccaaagatccttgttggaagtcatgcaatctttcccatctgccaagcctccattgggtgttttctttgccgctgttgccccaagattgcaaccaagatactactccatctcctcttctccaaagatgtccccaaacagaattcacgtcacttgtgctttggtttacgaaaccactccagctggtagaattcacagaggtttgtgttccacctggatgaagaatgccgtcccattaactgaatctccagactgttcccaagcttctatcttcgtcagaacttccaacttcagattgccagtcgatccaaaggtcccagttatcatgatcggtccaggtactggtttggctccattcagaggtttcttgcaagaaagattagctttgaaagaatctggtactgaattgggttcctccatcttcttcttcggttgtagaaacagaaaggtcgattttatctacgaagatgaattgaacaacttcgttgaaactggtgctttgtctgaattgattgtcgctttctccagagaaggtactgccaaggaatacgtccaacacaagatgtcccaaaaggcttctgatatctggaagttgttgtctgaaggtgcttacttgtacgtttgtggtgatgctaaaggtatggccaaggacgttcacagaactttgcacactattgttcaagaacaaggttctttggactcctccaaggctgaattatacgtcaagaacttgcaaatgtccggtcgttacttgagagatgtatgg

SEQ ID NO: 78 - protein, 710 aa, Stevia rebaudiana
MQSDSVKVSPFDLVSAAMNGKAMEKLNASESEDPTTLPALKMLVENRELLTLFTTSFAVLIGCLVFLMWRRSSSKKLVQDPVPQVIVVKKKEKESEVDDGKKKVSIFYGTQTGTAEGFAKALVEEAKVRYEKTSFKVIDLDDYAADDDEYEEKLKKESLAFFFLATYGDGEPTDNAANFYKWFTEGDDKGEWLKKLQYGVFGLGNRQYEHFNKIAIVVDDKLTEMGAKRLVPVGLGDDDQCIEDDFTAWKELVWPELDQLLRDEDDTSVTTPYTAAVLEYRVVYHDKPADSYAEDQTHTNGHVVHDAQHPSRSNVAFKKELHTSQSDRSCTHLEFDISHTGLSYETGDHVGVYSENLSEVVDEALKLLGLSPDTYFSVHADKEDGTPIGGASLPPPFPPCTLRDALTRYADVLSSPKKVALLALAAHASDPSEADRLKFLASPAGKDEYAQWIVANQRSLLEVMQSFPSAKPPLGVFFAAVAPRLQPRYYSISSSPKMSPNRIHVTCALVYETTPAGRIHRGLCSTWMKNAVPLTESPDCSQASIFVRTSNFRLPVDPKVPVIMIGPGTGLAPFRGFLQERLALKESGTELGSSIFFFGCRNRKVDFIYEDELNNFVETGALSELIVAFSREGTAKEYVQHKMSQKASDIWKLLSEGAYLYVCGDAKGMAKDVHRTLHTIVQEQGSLDSSKAELYVKNLQMSGRYLRDVW

SEQ ID NO: 79 - DNA, 1575 bp, Saccharomyces cerevisiae
  CDS (1)..(1575)
atggaccaattggtcaagactgaagtcaccaagaaatctttcactgctccagtccaaaaggcttccactccagttttgaccaacaagaccgtcatctccggttccaaggttaaatctttgtcctctgctcaatcttcctcctctggtccatcttcttcttctgaagaagatgattccagagatatcgaatctttggacaagaaaatcagaccattggaagaattggaagctctattgtcctctggtaacactaagcaattaaagaacaaggaagttgctgctttggttatccacggtaaattgccattgtacgctttggaaaagaaattaggtgacaccaccagagctgttgctgtcagaagaaaggctttgtccattttggctgaagctccagtcttggcttccgacagattaccatacaagaactacgactacgaccgtgtctttggtgcttgttgtgaaaatgtcattggttacatgccattaccagttggtgtcattggtccattggttatcgacggtacttcttaccacatcccaatggctaccactgaaggttgtttggttgcttctgccatgagaggttgtaaggccatcaacgctggtggtggtgctaccaccgttttgactaaggatggtatgaccagaggtcctgttgtcagattcccaactttgaagagatctggtgcttgtaagatctggttggattctgaagaaggtcaaaacgccatcaagaaggctttcaactccacttccagattcgctagattgcaacacattcaaacttgtttagctggtgacttgttgttcatgagattcagaaccaccactggtgacgctatgggtatgaacatgatctccaagggtgttgaatactctttgaagcaaatggttgaagaatacggttgggaagatatggaagttgtctctgtttctggtaactactgtaccgacaagaagccagctgccatcaactggatcgaaggtcgtggtaagtccgttgttgctgaagctaccattccaggtgacgttgtcagaaaggttttgaaatctgatgtttctgctttagtcgaattgaacattgccaagaacttggtcggttctgccatggctggttccgtcggtggtttcaacgctcatgccgctaacttggtcactgctgttttcttggctttaggtcaagatccagctcaaaatgtcgaatcctctaactgtatcactttgatgaaggaagttgacggtgatttgagaatttctgtttccatgccatccattgaagtcggtactatcggtggtggtactgtcttggaaccacaaggtgccatgttggacttgttgggtgttcgtggtccacacgctaccgctccaggtactaacgccagacaattggccagaattgttgcctgtgccgtcttggctggtgaattgtctctatgtgccgctttggctgctggtcacttggttcaatctcacatgacccacaacagaaagcctgctgaaccaaccaaaccaaacaacttggatgctactgacattaacagattaaaggacggttctgtcacctgtatcaagtct

SEQ ID NO: 80 - protein, 525 aa, Saccharomyces cerevisiae
MDQLVKTEVTKKSFTAPVQKASTPVLTNKTVISGSKVKSLSSAQSSSSGPSSSSEEDDSRDIESLDKKIRPLEELEALLSSGNTKQLKNKEVAALVIHGKLPLYALEKKLGDTTRAVAVRRKALSILAEAPVLASDRLPYKNYDYDRVFGACCENVIGYMPLPVGVIGPLVIDGTSYHIPMATTEGCLVASAMRGCKAINAGGGATTVLTKDGMTRGPVVRFPTLKRSGACKIWLDSEEGQNAIKKAFNSTSRFARLQHIQTCLAGDLLFMRFRTTTGDAMGMNMISKGVEYSLKQMVEEYGWEDMEVVSVSGNYCTDKKPAAINWIEGRGKSVVAEATIPGDVVRKVLKSDVSALVELNIAKNLVGSAMAGSVGGFNAHAANLVTAVFLALGQDPAQNVESSNCITLMKEVDGDLRISVSMPSIEVGTIGGGTVLEPQGAMLDLLGVRGPHATAPGTNARQLARIVACAVLAGELSLCAALAAGHLVQSHMTHNRKPAEPTKPNNLDATDINRLKDGSVTCIKS

SEQ ID NO: 81 - DNA, 1056 bp, Saccharomyces cerevisiae
  CDS (1)..(1056)
atggcttctgaaaaggaaatcagaagagaacgtttcttgaatgttttcccaaaattggttgaagaattgaacgcttctctattagcttacggtatgccaaaggaagcttgtgactggtacgctcactctttgaactacaacaccccaggtggtaagttgaacagaggtctatccgttgttgacacctacgccattttgtccaacaagaccgtcgaacaattaggtcaagaagaatacgaaaaggttgccatcttaggttggtgtatcgaattgttgcaagcttacttcttggttgctgatgacatgatggacaaatctatcaccagaagaggtcaaccatgttggtacaaggttccagaagtcggtgaaattgccatcaacgatgctttcatgttggaagctgccatctacaagttgttgaagtctcacttcagaaacgaaaagtactacattgacatcactgaattattccacgaagttactttccaaaccgaattgggtcaattgatggacttgattaccgctccagaagataaggtcgatttgtccaaattttccttgaagaaacactctttcattgtcactttcaagactgcttactactccttttacttgcctgttgctttggccatgtatgtcgctggtatcaccgatgaaaaggacttgaagcaagctcgtgatgtcttgattccattaggtgaatacttccaaatccaagatgactacttggactgtttcggtactccagaacaaatcggtaagattggtactgatatccaagacaacaagtgttcctgggttatcaacaaggctttggaattggcttctgctgaacaaagaaagactttggacgaaaactacggtaagaaggactctgttgctgaagctaagtgtaagaagatcttcaacgatttgaaaattgaacaattataccatgaatacgaagaatctattgccaaggacttgaaagccaagatctctcaagtcgacgaatccagaggtttcaaggctgatgtcttgactgctttcttgaacaaggtctacaagagatcaaaa

SEQ ID NO: 82 - protein, 352 aa, Saccharomyces cerevisiae
MASEKEIRRERFLNVFPKLVEELNASLLAYGMPKEACDWYAHSLNYNTPGGKLNRGLSVVDTYAILSNKTVEQLGQEEYEKVAILGWCIELLQAYFLVADDMMDKSITRRGQPCWYKVPEVGEIAINDAFMLEAAIYKLLKSHFRNEKYYIDITELFHEVTFQTELGQLMDLITAPEDKVDLSKFSLKKHSFIVTFKTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 83 - DNA, 1005 bp, Saccharomyces cerevisiae
  CDS (1)..(1005)
atggaagctaagattgacgaattgatcaacaacgaccctgtctggtcctctcaaaacgaatctttgatctccaagccatacaaccacatcttgttgaagccaggtaagaacttcagattaaacttgattgttcaaatcaacagagttatgaacttgccaaaggaccaattggccattgtttcccaaattgtcgaattgttgcacaactcctctctattgatcgatgacattgaagataatgctccattaagaagaggtcaaaccacttctcatttgattttcggtgtcccatccaccatcaacactgctaactacatgtacttcagagccatgcaattggtttctcaattgaccaccaaggaaccattataccacaacttgatcactatctttaacgaagaattgattaacttgcaccgtggtcaaggtttggacatctactggagagatttcttgccagaaattattccaactcaagaaatgtacttgaacatggtcatgaacaagactggtggtttattcagattgactttacgtttgatggaagctttgtctccatcttcccaccacggtcactctttggttccattcatcaatctattaggtatcatctaccaaatcagagatgattacttgaacttgaaggacttccaaatgtcctctgaaaagggtttcgctgaagatatcactgaaggtaaattgtctttcccaattgtccacgccttgaactttaccaagaccaagggtcaaactgaacaacacaacgaaattttgagaatcttattgttgagaacttctgacaaggacatcaagttgaaattgatccaaatcttggaattcgataccaactctttggcttacaccaagaacttcatcaaccaattggttaacatgatcaagaatgacaacgaaaacaaatacttgccagacttggcttcccactccgataccgctaccaacttgcacgacgaattgttgtacattattgaccatttgtctgagtta

SEQ ID NO: 84 - protein, 335 aa, Saccharomyces cerevisiae [sequence omitted]

SEQ ID NO: 85 - DNA, 1575 bp, Gibberella fujikuroi
  CDS (1)..(1575)
atgtccaagtctaactccatgaactccacttctcacgaaactttattccaacaattggttttgggtttggacagaatgccattgatggatgtccactggttgatctacgttgctttcggtgcttggttatgttcctacgtcattcacgttttgtcctcttcttctaccgtcaaggttccagttgtcggttacagatccgttttcgaaccaacctggttattgagattaagatttgtctgggaaggtggttccattattggtcaaggttacaacaaattcaaggactctatcttccaagtcagaaagttgggtactgacattgttatcatcccaccaaactacatcgatgaagtcagaaagttgtcccaagacaagaccagatctgttgaaccattcatcaacgatttcgctggtcaatacaccagaggtatggtctttctacaatctgatttgcaaaaccgtgtcatccaacaaagattgactccaaagttggtttctttgactaaggtcatgaaggaagaattggactacgctttgaccaaggaaatgccagacatgaagaacgacgaatgggttgaagttgacatttcttccatcatggtcagattgatctccagaatctctgcccgtgttttcttgggtccagaacactgtcgtaaccaagaatggttgaccaccactgctgaatactctgaatctttattcatcactggtttcatcttgagagttgtcccacacatcttaagaccattcattgctccattgttgccttcttacagaactttgttgagaaatgtctcttctggtagaagagttatcggtgatatcatcagatctcaacaaggtgatggtaacgaagatatcttgtcctggatgagagatgctgctaccggtgaagaaaagcaaattgacaacattgctcaaagaatgttgatcttgtctttggcttccattcacaccaccgccatgaccatgacccatgccatgtacgacttgtgtgcctgtccagaatacattgaaccattacgtgacgaagtcaaatccgttgttggtgcttctggttgggacaagactgctttgaacagattccacaagttggactctttcttgaaggaatctcaaagattcaacccagttttcttgttgactttcaacagaatctaccatcaatccatgactttgtccgatggtaccaacattccatctggtaccagaattgctgttccatctcacgctatgttgcaagattctgctcacgttccaggtccaactcctccaactgaatttgacggtttcagatactccaagatcagatctgactctaactatgctcaaaagtacttgttctccatgaccgattcttccaacatggctttcggttacggtaagtacgcttgtccaggtcgtttctacgcctccaacgaaatgaaattgactttggccattttgttgttgcaatttgaattcaaattgccagatggtaagggtagaccaagaaacatcactatcgactctgacatgattccagacccaagagctagattatgtgtcagaaagagatctctacgtgacgaa

SEQ ID NO: 86 - protein, 525 aa, Gibberella fujikuroi
MSKSNSMNSTSHETLFQQLVLGLDRMPLMDVHWLIYVAFGAWLCSYVIHVLSSSSTVKVPVVGYRSVFEPTWLLRLRFVWEGGSIIGQGYNKFKDSIFQVRKLGTDIVIIPPNYIDEVRKLSQDKTRSVEPFINDFAGQYTRGMVFLQSDLQNRVIQQRLTPKLVSLTKVMKEELDYALTKEMPDMKNDEWVEVDISSIMVRLISRISARVFLGPEHCRNQEWLTTTAEYSESLFITGFILRVVPHILRPFIAPLLPSYRTLLRNVSSGRRVIGDIIRSQQGDGNEDILSWMRDAATGEEKQIDNIAQRMLILSLASIHTTAMTMTHAMYDLCACPEYIEPLRDEVKSVVGASGWDKTALNRFHKLDSFLKESQRFNPVFLLTFNRIYHQSMTLSDGTNIPSGTRIAVPSHAMLQDSAHVPGPTPPTEFDGFRYSKIRSDSNYAQKYLFSMTDSSNMAFGYGKYACPGRFYASNEMKLTLAILLLQFEFKLPDGKGRPRNITIDSDMIPDPRARLCVRKRSLRDE

SEQ ID NO: 87 - DNA, 1419 bp, Stevia rebaudiana
  CDS (1)..(1419)
atggccacttctgactccatcgttgatgacagaaagcaattgcacgttgctactttcccatggttagctttcggtcacattttgccatacttgcaattgtccaaattgattgctgaaaagggtcacaaagtctctttcttgtccaccaccagaaacatccaaagattatcttctcacatttctccattgatcaacgttgtccaattgactttaccaagagttcaagaattgccagaagatgctgaagctaccaccgatgtccatccagaagatatcccatacttgaagaaggcttctgatggtttgcaaccagaagtcactagattcttggaacaacactctccagactggattatctacgactacactcactactggttaccatccattgctgcctctttgggtatctctcgtgctcatttctccgttaccactccatgggctattgcttacatgggtccatctgctgatgctatgatcaacggttctgatggtagaaccactgtcgaagacttgaccactccaccaaaatggttcccattcccaaccaaggtctgttggagaaagcacgatttggccagattagttccatacaaggccccaggtatctctgacggttacagaatgggtttagtcttgaagggttctgactgtttgttgtccaagtgttaccatgaattcggtactcaatggttacctttgttggaaactttgcaccaagtcccagttgttccagttggtttgttgcctcctgaaatcccaggtgacgaaaaggacgaaacctgggtttccatcaagaaatggttagatggtaagcaaaagggttccgttgtctacgttgctttgggttctgaagtcttggtttctcaaactgaagttgttgaattggctttgggtttggaattgtccggtctaccatttgtctgggcttacagaaagccaaagggtccagctaagtctgactctgttgaattgccagatggtttcgtcgaaagaaccagagacagaggtttggtctggacttcctgggctccacaattgagaattttgtcccacgaatctgtttgtggtttcttgacccactgtggttctggttccattgtcgaaggtttgatgttcggtcacccattgatcatgttgccaatcttcggtgaccaaccattgaacgctagattattggaagacaagcaagtcggtattgaaatcccaagaaacgaagaagacggttgtttgaccaaggaatctgttgcccgttctctaagatctgttgttgtcgaaaaggaaggtgaaatctacaaggctaacgctagagaattgtccaagatctacaacgataccaaggtcgaaaaggaatatgtctcccaatttgttgactacttggaaaagaacgctcgtgccgttgccattgaccacgaaagc

SEQ ID NO: 88 - protein, 473 aa, Stevia rebaudiana
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 89 - DNA, 1575 bp, Stevia rebaudiana
  CDS (1)..(1575)
atgggtttgttcccattagaggattcctacgcgctggtctttgaaggactagcaataacactggctttgtactatctactgtctttcatctacaaaacatctaaaaagacatgtacacctcctaaagcatctggtgaaatcattccaattacaggaatcatattgaatctgctatctggctcaagtggtctacctattatcttagcacttgcctctttagcagacagatgtggtcctattttcaccattaggctgggtattaggagagtgctagtagtatcaaattgggaaatcgctaaggagattttcactacccacgatttgatagtttctaatagaccaaaatacttagccgctaagattcttggtttcaattatgtttcattctctttcgctccatacggcccatattgggtcggaatcagaaagattattgctacaaaactaatgtcttcttccagacttcagaagttgcaatttgtaagagtttttgaactagaaaactctatgaaatctatcagagaatcatggaaggagaaaaaggatgaagagggaaaggtattagttgagatgaaaaagtggttctgggaactgaatatgaacatagtgttaaggacagttgctggtaaacaatacactggtacagttgatgatgccgatgcaaagcgtatctccgagttattcagagaatggtttcactacactggcagatttgtcgttggagatgcttttccttttctaggttggttggacctgggcggatacaaaaagacaatggaattagttgctagtagattggactcaatggtcagtaaatggttagatgagcatcgtaaaaagcaagctaacgatgacaaaaaggaggatatggatttcatggatatcatgatctccatgacagaagcaaattcaccacttgaaggatacggcactgatactattatcaagaccacatgtatgactttgattgtttcaggagttgatacaacctcaatcgtacttacttgggccttatcacttttgttaaacaacagagatactttgaaaaaggcacaagaggaattagatatgtgcgtaggtaaaggaagacaagtcaacgagtctgatcttgttaacttgatatacttggaagcagtgcttaaagaggctttaagactttacccagcagcgttcttaggcggaccaagagcattcttggaagattgtactgttgctggttatagaattccaaagggcacctgcttgttgattaacatgtggaaactgcatagagatccaaacatttggagtgatccttgcgaattcaagccagaaagatttttgacacctaatcaaaaggatgttgatgtgatcggtatggatttcgaattgataccatttggtgccggcagaagatattgtccaggtactagattggctttacagatgttgcatatcgtattagcgacattgctgcaaaacttcgaaatgtcaacaccaaacgatgcgccagtcgatatgactgcttctgttggcatgacaaatgccaaagcatcacctttagaagtcttgctatcacctcgtgttaaatggtcc

SEQ ID NO: 90 - protein, 525 aa, Stevia rebaudiana
MGLFPLEDSYALVFEGLAITLALYYLLSFIYKTSKKTCTPPKASGEIIPITGIILNLLSGSSGLPIILALASLADRCGPIFTIRLGIRRVLVVSNWEIAKEIFTTHDLIVSNRPKYLAAKILGFNYVSFSFAPYGPYWVGIRKIIATKLMSSSRLQKLQFVRVFELENSMKSIRESWKEKKDEEGKVLVEMKKWFWELNMNIVLRTVAGKQYTGTVDDADAKRISELFREWFHYTGRFVVGDAFPFLGWLDLGGYKKTMELVASRLDSMVSKWLDEHRKKQANDDKKEDMDFMDIMISMTEANSPLEGYGTDTIIKTTCMTLIVSGVDTTSIVLTWALSLLLNNRDTLKKAQEELDMCVGKGRQVNESDLVNLIYLEAVLKEALRLYPAAFLGGPRAFLEDCTVAGYRIPKGTCLLINMWKLHRDPNIWSDPCEFKPERFLTPNQKDVDVIGMDFELIPFGAGRRYCPGTRLALQMLHIVLATLLQNFEMSTPNDAPVDMTASVGMTNAKASPLEVLLSPRVKWS

SEQ ID NO: 91 - DNA, 1428 bp, Stevia rebaudiana
  CDS (1)..(1428)
atgatacaagttttaactccaattctactcttcctcatcttcttcgttttctggaaagtctacaaacatcaaaagactaaaatcaatctaccaccaggttccttcggctggccatttttgggtgaaaccttagccttacttagagcaggctgggattctgagccagaaagattcgtaagagagcgtatcaaaaagcatggatctccacttgttttcaagacatcactatttggagacagattcgctgttctttgcggtccagctggtaataagtttttgttctgcaacgaaaacaaattagtggcatcttggtggccagtccctgtaaggaagttgttcggtaaaagtttactcacaataagaggagatgaagcaaaatggatgagaaaaatgctattgtcttacttgggtccagatgcatttgccacacattatgccgttactatggatgttgtaacacgtagacatattgatgtccattggaggggcaaggaggaagttaatgtatttcaaacagttaagttgtacgcattcgaattagcttgtagattattcatgaacctagatgacccaaaccacatcgcgaaactcggtagtcttttcaacattttcctcaaagggatcatcgagcttcctatagacgttcctggaactagattttactccagtaaaaaggccgcagctgccattagaattgaattgaaaaagctcattaaagctagaaaactcgaattgaaggagggtaaggcgtcttcttcacaggacttgctttctcatctattaacatcacctgatgagaatgggatgttcttgacagaagaggaaatagtcgataacattctacttttgttattcgctggtcacgatacctctgcactatcaataacacttttgatgaaaaccttaggtgaacacagtgatgtgtacgacaaggttttgaaggaacaattagaaatttccaaaacaaaggaggcttgggaatcactaaagtgggaagatatccagaagatgaagtactcatggtcagtaatctgtgaagtcatgagattgaatcctcctgtcatagggacatacagagaggcgttggttgatatcgactatgctggttacactatcccaaaaggatggaagttgcattggtcagctgtttctactcaaagagatgaagccaatttcgaagatgtaactagattcgatccatccagatttgaaggggcaggccctactccattcacatttgtgcctttcggtggaggtcctagaatgtgtttaggcaaagagtttgccaggttagaagtgttagcatttctccacaacattgttaccaactttaagtgggatcttctaatccctgatgagaagatcgaatatgatccaatggctactccagctaagggcttgccaattagacttcatccacaccaagtc

SEQ ID NO: 92 - protein, 476 aa, Stevia rebaudiana; identical to SEQ ID NO: 32

SEQ ID NO: 93 - DNA, 1575 bp, Arabidopsis thaliana
  CDS (1)..(1575)
atggagtctttagtggttcatacagtaaatgctatctggtgtattgtaatcgtcgggattttctcagttggttatcacgtttacggtagagctgtggtcgaacaatggagaatgagaagatcactgaagctacaaggtgttaaaggcccaccaccatccatcttcaatggtaacgtttcagaaatgcaacgtatccaatccgaagctaaacactgctctggcgataacattatctcacatgattattcttcttcattattcccacacttcgatcactggagaaaacagtacggcagaatctacacatactctactggattaaagcaacacttgtacatcaatcatccagaaatggtgaaggagctatctcagactaacacattgaacttgggtagaatcacccatataaccaaaagattgaatcctatcttaggtaacggaatcataacctctaatggtcctcattgggcccatcagcgtagaattatcgcctacgagtttactcatgataagatcaagggtatggttggtttgatggttgagtctgctatgcctatgttgaataagtgggaggagatggtaaagagaggcggagaaatgggatgcgacataagagttgatgaggacttgaaagatgtttcagcagatgtgattgcaaaagcctgtttcggatcctcattttctaaaggtaaggctattttctctatgataagagatttgcttacagctatcacaaagagaagtgttctattcagattcaacggattcactgatatggtctttgggagtaaaaagcatggtgacgttgatatagacgctttagaaatggaattggaatcatccatttgggaaactgtcaaggaacgtgaaatagaatgtaaagatactcacaaaaaggatctgatgcaattgattttggaaggggcaatgcgttcatgtgacggtaacctttgggataaatcagcatatagaagatttgttgtagataattgtaaatctatctacttcgcagggcatgatagtacagctgtctcagtgtcatggtgtttgatgttactggccctaaacccatcatggcaagttaagatccgtgatgaaattctgtcttcttgcaaaaatggtattccagatgccgaaagtatcccaaaccttaaaacagtgactatggttattcaagagacaatgagattataccctccagcaccaatcgtcgggagagaagcctctaaagatatcagattgggcgatctagttgttcctaaaggcgtctgtatatggacactaataccagctttacacagagatcctgagatttggggaccagatgcaaacgatttcaaaccagaaagattttctgaaggaatttcaaaggcttgtaagtatcctcaaagttacattccatttggtctgggtcctagaacatgcgttggtaaaaactttggcatgatggaagtaaaggttcttgtttccctgattgtctccaagttctctttcactctatctcctacctaccaacatagtcctagtcacaaacttttagtagaaccacaacatggggtggtaattagagtggtt

SEQ ID NO: 94 - protein, 525 aa, Arabidopsis thaliana; identical to SEQ ID NO: 34

SEQ ID NO: 95 - DNA, 1587 bp, Vitis vinifera
  CDS (1)..(1587)
atgtacttcctactacaatacctcaacatcacaaccgttggtgtctttgccacattgtttctctcttattgtttacttctctggagaagtagagcgggtaacaaaaagattgccccagaagctgccgctgcatggcctattatcggccacctccacttacttgcaggtggatcccatcaactaccacatattacattgggtaacatggcagataagtacggtcctgtattcacaatcagaataggcttgcatagagctgtagttgtctcatcttgggaaatggcaaaggaatgttcaacagctaatgatcaagtgtcttcttcaagacctgaactattagcttctaagttgttgggttataactacgccatgtttggtttttcaccatacggttcatactggagagaaatgagaaagatcatctctctcgaattactatctaattccagattggaactattgaaagatgttagagcctcagaagttgtcacatctattaaggaactatacaaattgtgggcggaaaagaagaatgagtcaggattggtttctgtcgagatgaaacaatggttcggagatttgactttaaacgtgatcttgagaatggtggctggtaaaagatacttctccgcgagtgacgcttcagaaaacaaacaggcccagcgttgtagaagagtcttcagagaattcttccatctctccggcttgtttgtggttgctgatgctataccttttcttggatggctcgattggggaagacacgagaagaccttgaaaaagaccgccatagaaatggattccatcgcccaggagtggcttgaggaacatagacgtagaaaagattctggagatgataattctacccaagatttcatggacgttatgcaatctgtgctagatggcaaaaatctaggcggatacgatgctgatacgattaacaaggctacatgcttaactcttatatcaggtggcagtgatactactgtagtttctttgacatgggctcttagtcttgtgttaaacaatagagatactttgaaaaaggcacaggaagagttagacatccaagtcggtaaggaaagattggttaacgagcaagacatcagtaagttagtttacttgcaagcaatagtaaaagagacactcagactttatccaccaggtcctttgggtggtttgagacaattcactgaagattgtacactaggtggctatcacgtttcaaaaggaactagattaatcatgaacttatccaagattcaaaaagatccacgtatttggtctgatcctactgaattccaaccagagagattccttacgactcataaagatgtcgatccacgtggtaaacactttgaattcattccattcggtgcaggaagacgtgcatgtcctggtatcacattcggattacaagtactacatctaacattggcatctttcttgcatgcgtttgaattttcaacaccatcaaatgagcaggttaacatgagagaatcattaggtcttacgaatatgaaatctaccccattagaagttttgatttctccaagactatcccttaattgcttcaaccttatgaaaatt

SEQ ID NO: 96 - protein, 529 aa, Vitis vinifera
MYFLLQYLNITTVGVFATLFLSYCLLLWRSRAGNKKIAPEAAAAWPIIGHLHLLAGGSHQLPHITLGNMADKYGPVFTIRIGLHRAVVVSSWEMAKECSTANDQVSSSRPELLASKLLGYNYAMFGFSPYGSYWREMRKIISLELLSNSRLELLKDVRASEVVTSIKELYKLWAEKKNESGLVSVEMKQWFGDLTLNVILRMVAGKRYFSASDASENKQAQRCRRVFREFFHLSGLFVVADAIPFLGWLDWGRHEKTLKKTAIEMDSIAQEWLEEHRRRKDSGDDNSTQDFMDVMQSVLDGKNLGGYDADTINKATCLTLISGGSDTTVVSLTWALSLVLNNRDTLKKAQEELDIQVGKERLVNEQDISKLVYLQAIVKETLRLYPPGPLGGLRQFTEDCTLGGYHVSKGTRLIMNLSKIQKDPRIWSDPTEFQPERFLTTHKDVDPRGKHFEFIPFGAGRRACPGITFGLQVLHLTLASFLHAFEFSTPSNEQVNMRESLGLTNMKSTPLEVLISPRLSLNCFNLMKI

SEQ ID NO: 97 - DNA, 1437 bp, Medicago truncatula
  CDS (1)..(1437)
atggaacctaacttttacttgtcattactattgttgttcgtgaccttcatttctttaagtctgtttttcatcttttacaaacaaaagtccccattgaatttgccaccagggaaaatgggttaccctatcataggtgaaagtttagaattcctatccacaggctggaagggacatcctgaaaagttcatatttgatagaatgcgtaagtacagtagtgagttattcaagacttctattgtaggcgaatccacagttgtttgctgtggggcagctagtaacaaattcctattctctaacgaaaacaaactggtaactgcctggtggccagattctgttaacaaaatcttcccaacaacttcactggattctaatttgaaggaggaatctataaagatgagaaagttgctgccacagttcttcaaaccagaagcacttcaaagatacgtcggcgttatggatgtaatcgcacaaagacattttgtcactcactgggacaacaaaaatgagatcacagtttatccacttgctaaaagatacactttcttgcttgcgtgtagactgttcatgtctgttgaggatgaaaatcatgtggcgaaattctcagacccattccaactaatcgctgcaggcatcatttcacttcctatcgatcttcctggtactccattcaacaaggccataaaggcttcaaatttcattagaaaagagctgataaagattatcaaacaaagacgtgttgatctggcagagggtacagcatctccaacccaggatatcttgtcacatatgctattaacatctgatgaaaacggtaaatctatgaacgagttgaacattgccgacaagattcttggactattgataggaggccacgatacagcttcagtagcttgcacatttctagtgaagtacttaggagaattaccacatatctacgataaagtctaccaagagcaaatggaaattgccaagtccaaacctgctggggaattgttgaattgggatgacttgaaaaagatgaagtattcatggaatgtggcatgtgaggtaatgagattgtcaccacctttacaaggtggttttagagaggctataactgactttatgtttaacggtttctctattccaaaagggtggaagttatactggtccgccaactctacacacaaaaatgcagaatgtttcccaatgcctgagaaattcgatcctaccagatttgaaggtaatggtccagcgccttatacatttgtaccattcggtggaggccctagaatgtgtcctggaaaggaatacgctagattagaaatcttggttttcatgcataatctggtcaaacgttttaagtgggaaaaggttattccagacgaaaagattattgtcgatccattcccaatcccagctaaagatcttccaatccgtttgtatcctcacaaagct

SEQ ID NO: 98 - protein, 479 aa, Medicago truncatula
MEPNFYLSLLLLFVTFISLSLFFIFYKQKSPLNLPPGKMGYPIIGESLEFLSTGWKGHPEKFIFDRMRKYSSELFKTSIVGESTVVCCGAASNKFLFSNENKLVTAWWPDSVNKIFPTTSLDSNLKEESIKMRKLLPQFFKPEALQRYVGVMDVIAQRHFVTHWDNKNEITVYPLAKRYTFLLACRLFMSVEDENHVAKFSDPFQLIAAGIISLPIDLPGTPFNKAIKASNFIRKELIKIIKQRRVDLAEGTASPTQDILSHMLLTSDENGKSMNELNIADKILGLLIGGHDTASVACTFLVKYLGELPHIYDKVYQEQMEIAKSKPAGELLNWDDLKKMKYSWNVACEVMRLSPPLQGGFREAITDFMFNGFSIPKGWKLYWSANSTHKNAECFPMPEKFDPTRFEGNGPAPYTFVPFGGGPRMCPGKEYARLEILVFMHNLVKRFKWEKVIPDEKIIVDPFPIPAKDLPIRLYPHKA

SEQ ID NO: 99 - DNA, 1419 bp, Stevia rebaudiana
  CDS (1)..(1419)
atggctacatctgattctattgttgatgacaggaagcagttgcatgtggctactttcccttggcttgctttcggtcatatactgccttacctacaactatcaaaactgatagctgaaaaaggacataaagtgtcattcctttcaacaactagaaacattcaaagattatcttcccacatatcaccattgattaacgtcgttcaattgacacttccaagagtacaggaattaccagaagatgctgaagctacaacagatgtgcatcctgaagatatcccttacttgaaaaaggcatccgatggattacagcctgaggtcactagattccttgagcaacacagtccagattggatcatatacgactacactcactattggttgccttcaattgcagcatcactaggcatttctagggcacatttcagtgtaaccacaccttgggccattgcttacatgggtccatccgctgatgctatgattaacggcagtgatggtagaactaccgttgaagatttgacaaccccaccaaagtggtttccatttccaactaaagtctgttggagaaaacacgacttagcaagactggttccatacaaggcaccaggaatctcagacggctatagaatgggtttagtccttaaagggtctgactgcctattgtctaagtgttaccatgagtttgggacacaatggctaccacttttggaaacattacaccaagttcctgtcgtaccagttggtctattacctccagaaatccctggtgatgagaaggacgagacttgggtttcaatcaaaaagtggttagacgggaagcaaaaaggctcagtggtatatgtggcactgggttccgaagttttagtatctcaaacagaagttgtggaacttgccttaggtttggaactatctggattgccatttgtctgggcctacagaaaaccaaaaggccctgcaaagtccgattcagttgaattgccagacggctttgtcgagagaactagagatagagggttggtatggacttcatgggctccacaattgagaatcctgagtcacgaatctgtgtgcggtttcctaacacattgtggttctggttctatagttgaaggactgatgtttggtcatccacttatcatgttgccaatctttggtgaccagcctttgaatgcacgtctgttagaagataaacaagttggaattgaaatcccacgtaatgaggaagatggatgtttaaccaaggagtctgtggccagatcattacgttccgttgtcgttgaaaaggaaggcgaaatctacaaggccaatgcccgtgaactttcaaagatctacaatgacacaaaagtagagaaggaatatgtttctcaatttgtagattacctagagaaaaacgctagagccgtagctattgatcatgaatcc

SEQ ID NO: 100 - protein, 473 aa, Stevia rebaudiana; identical to SEQ ID NO: 88

SEQ ID NO: 101 - DNA, 1377 bp, Ipomoea purpurea
  CDS (1)..(1377)
atgggttctcaagctaccacctaccacatggccatgtacccatggttcggtgtcggtcatttgactggtttcttcagattggctaacaagttggctggtaagggtcacagaatctctttcttgattccaaagaacactcaatccaaattggaatctttcaacttgcacccacatttgatctctttcgttccaattgttgttccatccattccaggtctaccaccaggtgctgaaaccacctctgatgtcccattcccatctacccatttgttgatggaagctatggacaagactcaaaacgatattgaaatcatcttgaaggacttgaaggtcgatgtcgttttctacgatttcacccactggttaccatctttggccagaaagatcggtatcaaatccgtcttttactccaccatttctccattgatgcacggttacgctttgtccccagaaagaagagttgtcggtaagcaattgactgaagctgacatgatgaaggctccagcttctttcccagacccatccatcaaattgcacgctcacgaagccagaggtttcaccgccagaaccgttatgaagttcggtggtgatatcactttcttcgatcgtattttcactgctgtttctgaatctgatggtttggcttactccacttgtcgtgaaatcgaaggtcaattctgtgactacattgaaactcaattccaaaagccagtcttattggctggtccagctttgccagttccttccaagtccaccatggaacaaaaatggtctgactggttaggtaagttcaaggaaggttctgtcatttactgtgctttcggttctgaatgtaccttgagaaaggacaaattccaagaactattatggggtttggaattgactggtatgccattctttgctgctttgaagcctccatttgaaactgaatctgttgaagctgccatcccagaagaattgaaggaaaagatccaaggtagaggtatcgttcacggtgaatgggttcaacaacaattgtttttgcaacacccatctgttggttgtttcgtttcccactgtggttgggcttctttgtccgaagctttggtcaatgactgtcaaatcgtcttgttgccacaagtcggtgaccaaattattaacgccagaatcatgtccgtttctttgaaggttggtgttgaagtcgaaaagggtgaagaagatggtgttttctccagagaatctgtctgtaaggccgtcaaggctgtcatggatgaaaagtctgaaatcggtagagaagttagaggtaaccacgacaaattgagaggtttcttgatgaacgctgacttggactccaagtacatggactctttcaaccaaaagttgcaagacttattaggg

SEQ ID NO: 102 - protein, 459 aa, Ipomoea purpurea
MGSQATTYHMAMYPWFGVGHLTGFFRLANKLAGKGHRISFLIPKNTQSKLESFNLHPHLISFVPIVVPSIPGLPPGAETTSDVPFPSTHLLMEAMDKTQNDIEIILKDLKVDVVFYDFTHWLPSLARKIGIKSVFYSTISPLMHGYALSPERRVVGKQLTEADMMKAPASFPDPSIKLHAHEARGFTARTVMKFGGDITFFDRIFTAVSESDGLAYSTCREIEGQFCDYIETQFQKPVLLAGPALPVPSKSTMEQKWSDWLGKFKEGSVIYCAFGSECTLRKDKFQELLWGLELTGMPFFAALKPPFETESVEAAIPEELKEKIQGRGIVHGEWVQQQLFLQHPSVGCFVSHCGWASLSEALVNDCQIVLLPQVGDQIINARIMSVSLKVGVEVEKGEEDGVFSRESVCKAVKAVMDEKSEIGREVRGNHDKLRGFLMNADLDSKYMDSFNQKLQDLLG

SEQ ID NO: 103 - DNA, 1314 bp, Bellis perennis
  CDS (1)..(1314)
atggactctaagattgactccaagactttcagagttgttatgttgccatggttggcttactcccacatctcttctttcttggttttcgctaagagattgaccaaccacaacttccacatctacatctgttcctctcaaaccaacatgcaatacttgaagaacaacttgacttctcaatactccaagtccatccaattgattgaattgaacttgccatcttcttctgaattgccattgcaataccacaccacccacggtctaccacctcatttgaccaagactctatccgatgactaccaaaaatctggtccagacttcgaaaccatcttgatcaaattgaaccctcacttagtcatctacgacttcaaccaattatgggctccagaagttgcttccactttgcacattccatctatccaattgttgtccggttgtgttgctttgtacgctttggatgctcatttgtacaccaagccattggatgaaaacttggccaagttcccattcccagaaatctacccaaagaacagagatatcccaaagggtggttccaaatacatcgaaagatttgtcgactgtatgagaagatcttgtgaaatcatcttggtcagatccactatggaattggaaggtaagtacattgactacttgtctaagactttaggtaagaaggtcttaccagttggtccattagtccaagaagcttctttgttgcaagatgaccacatctggatcatgaaatggttggacaagaaggaagaatcctctgttgtctttgtttgtttcggttctgaatacattttgtctgacaacgaaatcgaagacattgcttacggtttggaattgtctcaagtctctttcgtctgggctatcagagccaagacctctgctttgaatggtttcattgaccgtgttggtgacaagggtttggtcattgacaaatgggttccacaagctaacatcttgtcccactcttccactggtggtttcatctcccactgtggttggtcctctaccatggaatccatcagatacggtgttccaatcattgctatgccaatgcaattcgatcaaccatacaacgccagattgatggaaactgtcggtgctggtattgaagttggtagagatggtgaaggtagattgaagcgtgaagaaattgccgctgttgtcagaaaggttgttgttgaagattctggtgaatctatcagagaaaaggccaaggaattaggtgaaattatgaagaagaacatggaagctgaagtcgatggtattgtcattgaaaacttagtcaaattgtgtgaaatgaacaac

SEQ ID NO: 104 - protein, 438 aa, Bellis perennis
MDSKIDSKTFRVVMLPWLAYSHISSFLVFAKRLTNHNFHIYICSSQTNMQYLKNNLTSQYSKSIQLIELNLPSSSELPLQYHTTHGLPPHLTKTLSDDYQKSGPDFETILIKLNPHLVIYDFNQLWAPEVASTLHIPSIQLLSGCVALYALDAHLYTKPLDENLAKFPFPEIYPKNRDIPKGGSKYIERFVDCMRRSCEIILVRSTMELEGKYIDYLSKTLGKKVLPVGPLVQEASLLQDDHIWIMKWLDKKEESSVVFVCFGSEYILSDNEIEDIAYGLELSQVSFVWAIRAKTSALNGFIDRVGDKGLVIDKWVPQANILSHSSTGGFISHCGWSSTMESIRYGVPIIAMPMQFDQPYNARLMETVGAGIEVGRDGEGRLKREEIAAVVRKVVVEDSGESIREKAKELGEIMKKNMEAEVDGIVIENLVKLCEMNN

SEQ ID NO: 105 - DNA, 1419 bp, Stevia rebaudiana
  CDS (1)..(1419)
atggccacttctgactctattgtcgatgacagaaagcaattgcacgttgccactttcccatggttggccttcggtcacattttgccatacttgcaattgtccaagttgattgctgaaaagggtcacaaggtttctttcttgtccactaccagaaacatccaaagattatcttctcacatctctccattaatcaacgttgtccaattgactttaccaagagttcaagaattgccagaagatgctgaagctaccaccgatgtccatccagaagatatcccatacttgaagaaggcttctgacggtttgcaacctgaagtcacccgtttcttggaacaacactctccagactggatcatctacgactacactcactactggttaccttccattgctgcttctttgggtatctcccgtgctcatttctccgtcaccactccatgggctattgcttacatgggtccatctgctgatgctatgatcaacggttctgatggtagaaccactgttgaagatttgaccactccaccaaaatggttcccattcccaactaaggtctgttggagaaagcacgatttggccagattggttccatacaaggctccaggtatctctgatggttacagaatgggtttggttttgaaaggttctgactgtttgttgtccaaatgttaccatgaattcggtactcaatggttaccattgttggaaactttgcaccaagttccagttgttccagtcggtctattaccaccagaagtcccaggtgacgaaaaggacgaaacctgggtttccatcaagaaatggttagatggtaagcaaaagggttccgttgtctacgttgctttgggttctgaagtcttggtttctcaaactgaagttgtcgaattggctttaggtttggaattgtccggtttgcctttcgtctgggcttacagaaagccaaagggtccagctaaatctgactccgtcgaattaccagacggtttcgttgaaagaacccgtgacagaggtttggtctggacttcctgggctccacaattgagaatcttgtcccacgaatctgtttgtggtttcttgacccactgtggttctggttccattgtcgaaggtttgatgtttggtcacccattgatcatgttgccaatcttcggtgaccaaccattgaacgccagattattggaagacaagcaagtcggtattgaaattccaagaaacgaagaagatggttgtttgaccaaggaatctgttgccagatctttgagatccgttgttgtcgaaaaggaaggtgaaatctacaaggctaacgctagagaattgtctaagatctacaacgacaccaaggttgaaaaggaatacgtttctcaatttgtcgactacttggaaaagaacaccagagctgttgccattgaccacgaaagt

SEQ ID NO: 106 - protein, 473 aa, Stevia rebaudiana
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEVPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNTRAVAIDHES

SEQ ID NO: 107 - DNA, 1455 bp, Stevia rebaudiana
  CDS (1)..(1455)
atgtacaacgtcacctaccatcaaaactccaaggctatggctacttctgactctattgtcgatgacagaaagcaattgcacgttgccactttcccatggttagctttcggtcacatcttaccattcttgcaattgtccaaattgattgctgaaaagggtcacaaggtttctttcttgtctaccactagaaacattcaaagattgtcttcccacatctctccattgatcaacgttgttcaattgactctaccaagagtccaagaattaccagaagatgctgaagctaccaccgatgtccatccagaagatatccaatacttgaagaaggctgttgacggtttgcaaccagaagttaccagattcttggaacaacactctccagactggatcatctacgacttcacccactactggttaccttccattgctgcctccttgggtatctccagagcttacttctgtgttatcactccatggaccattgcttacttggctccatcttctgatgctatgatcaacgactctgacggtagaaccactgtcgaagatttgaccactccacctaaatggttcccattcccaactaaggtctgttggagaaagcatgacttggccagaatggaaccatacgaagctccaggtatctccgatggttacagaatgggtatggttttcaagggttctgactgtttgttgttcaagtgttaccacgaattcggtactcaatggttaccattgttggaaactttgcaccaagtcccagttgtcccagtcggtttgttgccaccagaaatcccaggtgacgaaaaggacgaaacctgggtttccatcaagaaatggttggatggtaagcaaaagggttccgttgtctacgttgccttgggttctgaagctttagtctctcaaactgaagttgttgaattggctttgggtttggaattgtctggtctaccatttgtctgggcttacagaaagccaaagggtccagccaaatctgactccgttgaattgccagatggtttcgtcgaacgtaccagagacagaggtttagtctggacttcctgggctcctcaattgagaatcttgtctcacgaatctgtctgtggtttcttgactcactgtggttctggttccattgtcgaaggtttgatgttcggtcacccattgattatgttgccaattttctgtgaccaaccattgaacgctagattattggaagacaaacaagtcggtattgaaatcccaagaaacgaagaagatggttgtttgaccaaggaatctgttgctcgttctttgagatctgttgttgtcgaaaacgaaggtgaaatctacaaggccaatgctcgtgctttgtccaagatctacaacgataccaaggttgaaaaggaatacgtttctcaatttgttgactacttggaaaagaacgccagagctgttgccattgaccacgaatcc

SEQ ID NO: 108 - protein, 485 aa, Stevia rebaudiana
MYNVTYHQNSKAMATSDSIVDDRKQLHVATFPWLAFGHILPFLQLSKLIAEKGHKVSFLSTTRNIQRLSSHISPLINVVQLTLPRVQELPEDAEATTDVHPEDIQYLKKAVDGLQPEVTRFLEQHSPDWIIYDFTHYWLPSIAASLGISRAYFCVITPWTIAYLAPSSDAMINDSDGRTTVEDLTTPPKWFPFPTKVCWRKHDLARMEPYEAPGISDGYRMGMVFKGSDCLLFKCYHEFGTQWLPLLETLHQVPVVPVGLLPPEIPGDEKDETWVSIKKWLDGKQKGSVVYVALGSEALVSQTEVVELALGLELSGLPFVWAYRKPKGPAKSDSVELPDGFVERTRDRGLVWTSWAPQLRILSHESVCGFLTHCGSGSIVEGLMFGHPLIMLPIFCDQPLNARLLEDKQVGIEIPRNEEDGCLTKESVARSLRSVVVENEGEIYKANARALSKIYNDTKVEKEYVSQFVDYLEKNARAVAIDHES

SEQ ID NO: 109 - DNA, 1419 bp, Stevia rebaudiana
  CDS (1)..(1419)
atggccacttctgactccattgttgatgacagaaagcaattgcacgttgctactttcccatggttggcctttggtcacattttgcctttcttgcaattgtctaaattgattgctgaaaagggtcacaaggtttccttcttgtctaccaccagaaacatccaaagattatcttcccacatctctcctttgatcaacgttgttcaattgactctaccacgtgtccaagaattaccagaagacgctgaagctactaccgatgtccacccagaagatatccaatacttgaagaaggctgtcgatggtttgcaaccagaagtcaccagattcttggaacaacactctccagactggatcatctacgacttcactcactactggttgccatccattgctgcttctttgggtatctccagagcttacttctgtgtcatcactccatggaccattgcttacttggctccatcttctgatgctatgattaacgattctgatggtagaaccaccgtcgaagacttgaccactccaccaaaatggttcccattcccaaccaaggtctgttggagaaagcacgacttggccagaatggaaccatacgaagctccaggtatctccgatggttacagaatgggtatggttttcaagggttccgactgtctattattcaaatgttaccatgaatttggtactcaatggttaccattgttggaaactttgcaccaagtcccagttgttccagttggtttgttgcctccagaaatcccaggtgatgaaaaggacgaaacctgggtttccatcaagaaatggttggacggtaagcaaaagggttctgttgtctacgttgctttgggttctgaagctttggtttctcaaactgaagttgtcgaattggctttaggtttggaattgtccggtttgccattcgtctgggcttacagaaagccaaagggtccagctaagtctgactctgttgaattgccagatggtttcgttgaaagaaccagagacagaggtttggtctggacttcttgggctccacaattgagaattttgtcccacgaatctgtctgtggtttcttgactcactgtggttctggttccattgtcgaaggtttgatgttcggtcatccattgatcatgttgccattattcggtgaccaaccattgaacgctagattattggaagacaaacaagtcggtattgaaattccaagaaacgaagaagatggttgtttgaccaaggaatccgttgctcgttctttacgttctgtcgttgtcgaaaacgaaggtgaaatctacaaggccaatgccagagaattgtccaagatctacaacgacaccaaggttgaaaaggaatacgtttctcaatttgtcgactacttggaaaagaacgccagagctgttgccatcgaccacgaatcc

SEQ ID NO: 110 - protein, 473 aa, Stevia rebaudiana
MATSDSIVDDRKQLHVATFPWLAFGHILPFLQLSKLIAEKGHKVSFLSTTRNIQRLSSHISPLINVVQLTLPRVQELPEDAEATTDVHPEDIQYLKKAVDGLQPEVTRFLEQHSPDWIIYDFTHYWLPSIAASLGISRAYFCVITPWTIAYLAPSSDAMINDSDGRTTVEDLTTPPKWFPFPTKVCWRKHDLARMEPYEAPGISDGYRMGMVFKGSDCLLFKCYHEFGTQWLPLLETLHQVPVVPVGLLPPEIPGDEKDETWVSIKKWLDGKQKGSVVYVALGSEALVSQTEVVELALGLELSGLPFVWAYRKPKGPAKSDSVELPDGFVERTRDRGLVWTSWAPQLRILSHESVCGFLTHCGSGSIVEGLMFGHPLIMLPLFGDQPLNARLLEDKQVGIEIPRNEEDGCLTKESVARSLRSVVVENEGEIYKANARELSKIYNDTKVEKEYVSQFVDYLEKNARAVAIDHES

SEQ ID NO: 111 - DNA, 1356 bp, Populus trichocarpa
  CDS (1)..(1356)
atggacgaacctcacgaattgcacattgctatgttcccatggttggcctttggtcacatcattccattcttggaattagccaagttgattgctcaaagaggtcacaagatctctttcatctccactccaagaaacatccaaagattaccaaccatcccaccaaacttgaccccaagaatcaacttagtctctttggctttgccacacgttgaaaacttgccaaacaacgctgaagccactgctgacttgccattcgacaagatcccatacttgaagattgcttacgacagattgcaagactctttgttccatttcttgcactcttcttctccagactggatcatcttcgattttgcctcctactggttaccagaaattgctaccaaattgggtatctccggtgttttgttctccatcttcggtgcttggactttatctttcgctggtccatcttactctgccattttgaacggtgatgacccaagaaccgaaccacaacatttcaccgttccaccaaaatgggtcactttcccatccaaggttgctttccgtatccacgaagctaagagattcttggttcaaatcgaagctaactcttctggtgtcactgacatcttcagatggggttccgttttggctggttgtgatgtcattgccgtcagatcttgtttggaattggaagctgacttcttgagattggtcgaagatttgcactgtaagccagttatcccagtcggtctattaccacctccagctcaatgttctgaaggtggttccagagaaggtggtgtcgacgaaaaatgggttaccatttctgaatggttggacaagcaaactcaaggttccgttgtctacattgctttcggttctgaattgaccatcaaccaaaatgaaatcactgaattggctttgggtttagaattgtctggtttgccattcttctgggctttcagaaacagagatgactccgttagattgccagatggtttcgatgaaagagtcaagggtcgtggtgttgtctggacttcctgggctcctcaattgagaatcatggctcacgaatccgttggtggtttcttgactcactgtggttactcctctgttatcgaagctttgtccttcggtttggctttaatcatgttgccatttgccattgaccaaggtttgattgcccgtgttttcgaaggtaagaaggtcggtattgaagtcccaagagatgaacaagatggttccttcaccagaaactctgttgctgaatctctaagattggtcattgttgacaaggaaggttctgcttacagagaaaacgctaagcaacaaatggttactttgtttggtttgacctacaccatgacg

SEQ ID NO: 112 - protein, 452 aa, Populus trichocarpa
MDEPHELHIAMFPWLAFGHIIPFLELAKLIAQRGHKISFISTPRNIQRLPTIPPNLTPRINLVSLALPHVENLPNNAEATADLPFDKIPYLKIAYDRLQDSLFHFLHSSSPDWIIFDFASYWLPEIATKLGISGVLFSIFGAWTLSFAGPSYSAILNGDDPRTEPQHFTVPPKWVTFPSKVAFRIHEAKRFLVQIEANSSGVTDIFRWGSVLAGCDVIAVRSCLELEADFLRLVEDLHCKPVIPVGLLPPPAQCSEGGSREGGVDEKWVTISEWLDKQTQGSVVYIAFGSELTINQNEITELALGLELSGLPFFWAFRNRDDSVRLPDGFDERVKGRGVVWTSWAPQLRIMAHESVGGFLTHCGYSSVIEALSFGLALIMLPFAIDQGLIARVFEGKKVGIEVPRDEQDGSFTRNSVAESLRLVIVDKEGSAYRENAKQQMVTLFGLTYTMT

SEQ ID NO: 113 - DNA, 1362 bp, Stevia rebaudiana
  CDS (1)..(1362)
atgtccttgaaaggtaacgacaaggaattacatttggtcatgttcccattctttgctttcggtcacatcactccatttgtccaattgtccaacaagatctcctctttgtacccaggtgtcaagatcactttcttggctgcttctgcttctgtttccagaatcgaaaccatgttgaacccatctaccaacaccaaggtcattccattgactttgccaagagtcgatggtctaccagaaggtgttgaaaacactgctgacgcttctccagctaccattggtctattggttgttgccattgatttgatgcaacctcaaatcaagactttattggctaacttgaagccagacttcgttatcttcgacttcgtccactggtggttaccagaaattgcttctgaattgggtatcaagaccatctacttctccgtttacatggccaacattgtcatgccatccacttccaagttgaccggtaacaagccatctaccgtcgaagatatcaaggctttgcaacaatcttacggtattccagttaagactttcgaagccatctctttgatgaacgttttcaagtctttccacgactggatggacaaatgtatcaacggttgtaacttgatgttgatcaagtcttgtcgtgaaatggaaggttccagaattgacgatgtcaccaagcaatctaccagaccagttttcttgattggtccagttgttccagaacctcactctggtgaattggacgaaacctgggctaactggttgaacagattcccagctaagtctgtcatctactgttcctttggttctgaaactttcttgaccgatgaccaaatcagagaattggccttgggtttagaattgactggtttgccattcttcttggtcttgaacttcccagccaatgtcgacaaatctgctgaattgaagagaactttaccagatggtttcttggaaagagttaaggacaagggtattgtccactctggttgggttcaacaaagacacatcttggctcatgactctgttggttgttacgttttccacgctggttacggttccgttatcgaaggtttggtcaatgactgtcaattagtcatgttgccaatgaaggttgaccaattcaccaactccaaggttattgctttggaattgaaggctggtgttgaagttaacagaagagatgaagatggttacttcggtaaggacgatgtcttcgaagctgtcgaatctgtcatgatggacactgaaaacgaaccagccaagtccatcagagaaaaccaccgtaaattgaaggaatttttgcaaaacgatgaaatccaaaagaaatacattgctgatttcgttgaaaacttgaaagcgtta

SEQ ID NO: 114 - protein, 454 aa, Stevia rebaudiana
MSLKGNDKELHLVMFPFFAFGHITPFVQLSNKISSLYPGVKITFLAASASVSRIETMLNPSTNTKVIPLTLPRVDGLPEGVENTADASPATIGLLVVAIDLMQPQIKTLLANLKPDFVIFDFVHWWLPEIASELGIKTIYFSVYMANIVMPSTSKLTGNKPSTVEDIKALQQSYGIPVKTFEAISLMNVFKSFHDWMDKCINGCNLMLIKSCREMEGSRIDDVTKQSTRPVFLIGPVVPEPHSGELDETWANWLNRFPAKSVIYCSFGSETFLTDDQIRELALGLELTGLPFFLVLNFPANVDKSAELKRTLPDGFLERVKDKGIVHSGWVQQRHILAHDSVGCYVFHAGYGSVIEGLVNDCQLVMLPMKVDQFTNSKVIALELKAGVEVNRRDEDGYFGKDDVFEAVESVMMDTENEPAKSIRENHRKLKEFLQNDEIQKKYIADFVENLKAL

SEQ ID NO: 115 - DNA, 1362 bp, Stevia rebaudiana
  CDS (1)..(1362)
atgtccttgaaaggtaacgacaaggaattacatttggtcatgttcccattctttgctttcggtcacatcactccatttgtccaattgtccaacaagatctcctctttgtacccaggtgtcaagatcactttcttggctgcttctgcttctgtttccagaatcgaaaccatgttgaacccatctaccaacaccaaggtcattccattgactttgccaagagtcgatggtctaccagaaggtgttgaaaacactgctgacgcttctccagctaccattggtctattggttgttgccattgatttgatgcaacctcaaatcaagactttattggctaacttgaagccagacttcgttatcttcgacttcgtccactggtggttaccagaaattgcttctgaattgggtatcaagaccatctacttctccgtttacatggccaacattgtcatgccatccacttccaagttgaccggtaacaagccatctaccgtcgaagatatcaaggctttgcaacaatctgacggtattccagttaagactttcgaagccatctctttgatgaacgttttcaagtctttccacgactggatggacaaatgtatcaacggttgtaacttgatgttgatcaagtcttgtcgtgaaatggaaggttccagaattgacgatgtcaccaagcaatctaccagaccagttttcttgattggtccagttgttccagaacctcactctggtgaattggacgaaacctgggctaactggttgaacagattcccagctaagtctgtcatctactgttcctttggttctgaaactttcttgaccgatgaccaaatcagagaattggccttgggtttagaattgactggtttgccattcttcttggtcttgaacttcccagccaatgtcgacaaatctgctgaattgaagagaactttaccagatggtttcttggaaagagttaaggacaagggtattgtccactctggttgggttcaacaaagacacatcttggctcatgactctgttggttgttacgttttccacgctggttacggttccgttatcgaaggtttggtcaatgactgtcaattagtcatgttgccaatgaaggttgaccaattcaccaactccaaggttattgctttggaattgaaggctggtgttgaagttaacagaagagatgaagatggttacttcggtaaggacgatgtcttcgaagctgtcgaatctgtcatgatggacactgaaaacgaaccagccaagtccatcagagaaaaccaccgtaaattgaaggaatttttgcaaaacgatgaaatccaaaagaaatacattgctgatttcgttgaaaacttgaaagcgtta

SEQ ID NO: 116 - protein, 454 aa, Stevia rebaudiana
MSLKGNDKELHLVMFPFFAFGHITPFVQLSNKISSLYPGVKITFLAASASVSRIETMLNPSTNTKVIPLTLPRVDGLPEGVENTADASPATIGLLVVAIDLMQPQIKTLLANLKPDFVIFDFVHWWLPEIASELGIKTIYFSVYMANIVMPSTSKLTGNKPSTVEDIKALQQSDGIPVKTFEAISLMNVFKSFHDWMDKCINGCNLMLIKSCREMEGSRIDDVTKQSTRPVFLIGPVVPEPHSGELDETWANWLNRFPAKSVIYCSFGSETFLTDDQIRELALGLELTGLPFFLVLNFPANVDKSAELKRTLPDGFLERVKDKGIVHSGWVQQRHILAHDSVGCYVFHAGYGSVIEGLVNDCQLVMLPMKVDQFTNSKVIALELKAGVEVNRRDEDGYFGKDDVFEAVESVMMDTENEPAKSIRENHRKLKEFLQNDEIQKKYIADFVENLKAL

SEQ ID NO: 117 - DNA, 1449 bp, Stevia rebaudiana
  CDS (1)..(1449)
atggaccaaatggccaagattgacgaaaagaagcctcacgttgttttcattccattcccagctcaatctcacatcaagtgtatgttgaaattggccagaattttgcaccaaaagggtttgtacatcactttcatcaacactgacaccaaccacgaaagattggttgcctccggtggtactcaatggttggaaaatgctccaggtttctggttcaagaccgtcccagatggtttcggttctgccaaggatgacggtgtcaagccaactgatgctttgagagaattgatggactacttgaagaccaacttcttcgatttgttcttggacttggtcttgaagttggaagttccagctacctgtatcatctgtgatggttgtatgacctttgctaacaccattagagctgctgaaaagttgaacattccagtcatcttattctggaccatggctgcttgtggtttcatggctttctaccaagctaaggtcttaaaggaaaaggaaattgttccagtcaaggacgaaacctacttgaccaatggttacttggacatggaaattgactggatcccaggtatgaagagaatcagattacgtgacttgcctgaattcatcttggccaccaagcaaaactactttgctttcgaattcttgtttgaaactgctcaattagctgacaaggtttctcacatgatcattcacactttcgaagaattggaagcttctttagtctctgaaatcaaatctattttcccaaacgtttacactatcggtccattacaattgttgttgaacaagatcactcaaaaggaaaccaacaacgattcttactctttatggaaggaagaaccagaatgtgtcgaatggttgaactccaaggaaccaaactccgttgtttacgtcaactttggttctttggctgtcatgtctttgcaagatttggtcgaattcggttggggtttggttaactccaaccattacttcttatggatcatcagagctaacttgattgacggtaagccagctgtcatgccacaagaattgaaggaagccatgaacgaaaaaggtttcgttggttcttggtgttcccaagaagaagttttgaaccatccagccgttggtggtttcttgactcactgtggctggggttccatcattgaatctctatccgctggtgttccaatgttgggttggccatccattggtgaccaaagagccaactgtcgtcaaatgtgtaaggaatgggaagttggtatggaaatcggtaagaacgttaagagagatgaagtcgaaaaattagtcagaatgttgatggaaggtttggaaggtgaaagaatgagaaagaaggctttggaatggaagaaatctgctactttggctacttgttgtaacggttcctcttctttggatgttgaaaaattggctaacgaaatcaagaaattgtccaggaac

SEQ ID NO: 118 - protein, 483 aa, Stevia rebaudiana
MDQMAKIDEKKPHVVFIPFPAQSHIKCMLKLARILHQKGLYITFINTDTNHERLVASGGTQWLENAPGFWFKTVPDGFGSAKDDGVKPTDALRELMDYLKTNFFDLFLDLVLKLEVPATCIICDGCMTFANTIRAAEKLNIPVILFWTMAACGFMAFYQAKVLKEKEIVPVKDETYLTNGYLDMEIDWIPGMKRIRLRDLPEFILATKQNYFAFEFLFETAQLADKVSHMIIHTFEELEASLVSEIKSIFPNVYTIGPLQLLLNKITQKETNNDSYSLWKEEPECVEWLNSKEPNSVVYVNFGSLAVMSLQDLVEFGWGLVNSNHYFLWIIRANLIDGKPAVMPQELKEAMNEKGFVGSWCSQEEVLNHPAVGGFLTHCGWGSIIESLSAGVPMLGWPSIGDQRANCRQMCKEWEVGMEIGKNVKRDEVEKLVRMLMEGLEGERMRKKALEWKKSATLATCCNGSSSLDVEKLANEIKKLSRN

SEQ ID NO: 119 - DNA, 1404 bp, Stevia rebaudiana
  CDS (1)..(1404)
atgccaatctccgatatcaatgctggttcccacattttggttttcccatacccagctcaaggtcacatgttgactctattagatttgacccaccaattggccatcagaaacttgactatcactatcttagtcaccccaaagaacttgccaaccatttctccattgttggctgctcatccaaccactgtttctgctttgttgttgccattaccacctcacccagccatcccatctggtattgaaaacgtcaaggacttgccaaacgatgctttcaaggctatgatggttgctttaggtgacttgtacaacccattgagagactggttcagaaaccaacctaacccaccagttgccatcatttctgacttcttcttgggttggactcaccacttggctgtcgaattaggtatcagaagatacactttctctccatctggtgctttggctttgtccgtcattttctctttatggagataccaaccaaagagaatcgatgtcgaaaacgaaaaggaagctatcaaattcccaaagattccaaactctccagaatacccatggtggcaattatctccaatctacagatcttacgttgaaggtgacccagattctgaattcatcaaggatggtttcttggctgatattgcttcctggggtattgtcatcaactctttcaccgaattggaacaagtctacgttgaccatttgaagcatgaattgggtcacgaccaagtctttgctgtcggtccattattgcctccaggtgacaagacttctggtagaggtggttcttcttccaacgatgtcttgtcctggttggacacctgtgctgacagaaccgttgtctacgtttgtttcggttctcaaatggttttgaccaacggtcaaatggaagttgttgctttgggtttggaaaagtcccgtgtcaaatttgtctggtccgtcaaggaaccaactgttggtcacgaagctgctaactacggtcgtgttccaccaggtttcgaagacagagtttccggtcgtggtttggttatcagaggttgggttccacaagttgccattttgtctcacgactccgttggtgttttcttgacccactgtggttggaactctgtcatggaagctgttgctgctgaagttttgatgttgacctggccaatgtccgctgaccaattctccaatgccactttgttgcacgaattgaaggttggtatcaaggtttgtgaaggttccaacattgtcccaaactctgacgaattggctgaattgttctccaaatctctatccgatgaaactagattggaaagaaagagagtcaaggaatttgccaaatctgccaaggaagccgtcggtccaaagggttcctctgtcggtgaattagaaagattggttgacaacttgtctttg

SEQ ID NO: 120 - protein, 468 aa, Stevia rebaudiana
MPISDINAGSHILVFPYPAQGHMLTLLDLTHQLAIRNLTITILVTPKNLPTISPLLAAHPTTVSALLLPLPPHPAIPSGIENVKDLPNDAFKAMMVALGDLYNPLRDWFRNQPNPPVAIISDFFLGWTHHLAVELGIRRYTFSPSGALALSVIFSLWRYQPKRIDVENEKEAIKFPKIPNSPEYPWWQLSPIYRSYVEGDPDSEFIKDGFLADIASWGIVINSFTELEQVYVDHLKHELGHDQVFAVGPLLPPGDKTSGRGGSSSNDVLSWLDTCADRTVVYVCFGSQMVLTNGQMEVVALGLEKSRVKFVWSVKEPTVGHEAANYGRVPPGFEDRVSGRGLVIRGWVPQVAILSHDSVGVFLTHCGWNSVMEAVAAEVLMLTWPMSADQFSNATLLHELKVGIKVCEGSNIVPNSDELAELFSKSLSDETRLERKRVKEFAKSAKEAVGPKGSSVGELERLVDNLSL

SEQ ID NO: 121 - DNA, 1383 bp, Stevia rebaudiana
  CDS (1)..(1383)
atggaatcttccaaggtcattttgtacccatctccaggtattggtcacttggtttccatggtcgaattgggtaaattgattcacacccaccacccatctctatccgtcatcatcttggttttgccagctacctacgaaactggttccaccaccacctacatcaacactgtttctaccaccactccattcatcactttccaccacttgccagtcattccattgccaccagactcctcttctgaatttatcgatttggctttcgacattccacaattatacaacccagttgtctacaacactttggttgccatctctgaaacttccaccatcaaggctgttatcttggacttctttgtcaacgccgctttccaaatctccaagtctttggacttgccaacctactacttcttcacttctggtgcttctggtctatgtgctttcttgcatttgccaactatctacaagacctactccggtaacttcaaggacttggacactttcatcaacattccaggtgttcctcctatccactcttctgacatgccaaccgtcttattcgacaaggaatccaactcttacaagaactttgtcaagacttccaacaacatggccaaatcttctggtgtcattgctaactccttcttgcaattggaagaaagagctgctcaaactttgagagatggtaagtccatcaccgatggtccatctccaccaatctacttgattggtccattgatcgcttctggtaaccaagttgaccataatgaaaacgaatgtttgaaatggttaaacactcaaccatccaaatctgttgttttcttgtgtttcggttctcaaggtgttttcaagaaggaacaattgaaggaaattgctgttggtttggaaagatctggtcaaagattcttatgggttgtcagaaagcctccatctgatggtggtaaggaattcggtttggatgacgtcttgccagaaggtttcgttgccagaaccaaggaaaagggtttggttgtcaagaactgggctccacaaccagctattttgggtcacgaatctgtcggtggtttcgtttcccactgtggttggaactcttctttggaagccgttgttttcggtgtcccaatggttgcttggccattatacgctgaacaaaagatgaaccgtgtctacttggtcgaagaaatcaaggttgctttatggttaagaatgtccgctgatggttttgtctctgctgaagctgttgaagaaactgtcagacaattgatggacggtagaagagttcgtgaaagaattttggaaatgtccaccaaggccaaggccgctgtcgaagatggtggttcttccagagttgacttcttcaaattgactgaatcctggacccacaag

SEQ ID NO: 122 - protein, 461 aa, Stevia rebaudiana
MESSKVILYPSPGIGHLVSMVELGKLIHTHHPSLSVIILVLPATYETGSTTTYINTVSTTTPFITFHHLPVIPLPPDSSSEFIDLAFDIPQLYNPVVYNTLVAISETSTIKAVILDFFVNAAFQISKSLDLPTYYFFTSGASGLCAFLHLPTIYKTYSGNFKDLDTFINIPGVPPIHSSDMPTVLFDKESNSYKNFVKTSNNMAKSSGVIANSFLQLEERAAQTLRDGKSITDGPSPPIYLIGPLIASGNQVDHNENECLKWLNTQPSKSVVFLCFGSQGVFKKEQLKEIAVGLERSGQRFLWVVRKPPSDGGKEFGLDDVLPEGFVARTKEKGLVVKNWAPQPAILGHESVGGFVSHCGWNSSLEAVVFGVPMVAWPLYAEQKMNRVYLVEEIKVALWLRMSADGFVSAEAVEETVRQLMDGRRVRERILEMSTKAKAAVEDGGSSRVDFFKLTESWTHK

SEQ ID NO: 123 - DNA, 1455 bp, Stevia rebaudiana
  CDS (1)..(1455)
atgtacaacgttacttaccatcaaaactccaaggccatggctacctctgactccattgtcgacgacagaaagcaattgcacgttgccactttcccatggttggctttcggtcacatcttgccattcttgcaattgtccaaattgattgctgaaaagggtcacaaagtctctttcttgtctaccaccagaaacatccaaagattgtcctctcacatctctccattgattaacgttgtccaattgactttaccaagagtccaagaattgccagaagatgctgaagctactactgatgttcacccagaagatatccaatacttgaagaaggctgtcgatggtttgcaaccagaagttaccagattcttggaacaacactctccagactggatcatctacgacttcactcactactggttaccatccattgctgcttctttgggtatctccagagcttacttctgtgttatcactccatggaccattgcttacttggctccatcttctgatgccatgatcaacgactctgatggtagaaccactgttgaagatttgaccaccccacctaaatggttcccattcccaaccaaggtctgttggagaaagcatgatttggccagaatggaaccatacgaagctccaggtatctctgacggttacagaatgggtatggttttcaagggttctgactgtttgttgttcaaatgttaccatgaattcggtactcaatggttacctctattagaaactttgcaccaagttccagttgttccagtcggtttgttgcctccagaaatcccaggtgacgaaaaggacgaaacctgggtttccatcaagaaatggttggatggtaagcaaaagggttccgttgtctacgttgctttaggttctgaagctttagtctctcaaactgaagttgtcgaattggctttgggtttggaattgtccggtttgccatttgtctgggcttacagaaagccaaagggtccagccaagtctgattctgtcgaattaccagatggtttcgtcgaaagaacccgtgaccgtggtttggtctggacttcctgggctccacaattgagaattttgtcccacgaatctgtctgtggtttcttgactcactgtggttctggttccattgttgaaggtttgatgttcggtcacccattgatcatgttgccaatcttctgtgaccaaccattaaacgctagattgttggaagacaagcaagtcggtattgaaattccaagaaacgaagaagacggttgtttgaccaaggaatccgttgccagatctttgagatctgttgttgtcgaaaacgaaggtgaaatctacaaggctaacgctcgtgctctatccaagatctacaacgacaccaaggtcgaaaaggaatacgtttctcaatttgttgactacttggaaaagaacgccagagctgttgccattgaccacgaaagt

SEQ ID NO: 124 - protein, 485 aa, Stevia rebaudiana; identical to SEQ ID NO: 108

SEQ ID NO: 125 - DNA, 1485 bp, Stevia rebaudiana
  CDS (1)..(1485)
atgtctccaaagatggttgctccaccaaccaacttgcacttcgtcttattcccattgatggctcaaggtcacttggttccaatggtcgacattgctagaattttggctcaaagaggtgctaccgtcaccatcatcaccactccataccatgccaacagagtcagaccagttatctccagagccattgctaccaacttgaaaatccaattgttggaattgcaattgagatccactgaagctggtttgccagaaggttgtgaatctttcgaccaattgccatctttcgaatactggaagaacatctccactgccattgacttgttgcaacaaccagctgaagatctattgagagaattgtctccacctccagactgtatcatctccgatttcttgttcccatggaccactgatgtcgccagaagattgaacattccaagattggttttcaacggtccaggttgtttctacttgttgtgtatccacgttgccatcacttctaacatcttaggtgaaaacgaacctgtttcctccaacactgaaagagttgttttgccaggtttaccagatcgtattgaagttaccaaattgcaaatcgtcggttcttccagaccagctaacgttgacgaaatgggttcctggttaagagctgtcgaagctgaaaaggcttctttcggtattgtcgtcaacacctttgaagaattggaaccagaatacgtcgaagaatacaagaccgtcaaggacaagaagatgtggtgtatcggtccagtttctctatgtaacaagactggtccagacttggctgaaagaggtaacaaggctgccatcaccgaacacaactgtttgaaatggttggatgaaagaaagttgggttctgtcttgtacgtttgtttgggttctttggccagaatctccgctgctcaagccattgaattaggtttaggtttggaatctatcaacagaccatttatctggtgtgttagaaacgaaactgatgaattgaagacttggttcttggacggtttcgaagaaagagttcgtgacagaggtttgattgttcacggttgggctccacaagttttgatcttatctcacccaaccattggtggtttcttgactcactgtggttggaactctaccattgaatccatcactgctggtgttccaatgatcacctggccattctttgctgaccaattcttgaatgaagctttcatcgttgaagttttgaaaattggtgtcagaatcggtgttgaaagagcttgtttgttcggtgaagaagacaaggtcggtgtcttagtcaagaaggaagatgttaagaaggctgttgaatgtttgatggacgaagatgaagacggtgaccaaagaagaaagcgtgtcattgaattggccaagatggctaagattgctatggctgaaggtggttcttcttacgaaaacgtttcctctttgatcagagatgtcactgaaactgtccgtgctcctcat

SEQ ID NO: 126 - protein, 495 aa, Stevia rebaudiana
MSPKMVAPPTNLHFVLFPLMAQGHLVPMVDIARILAQRGATVTIITTPYHANRVRPVISRAIATNLKIQLLELQLRSTEAGLPEGCESFDQLPSFEYWKNISTAIDLLQQPAEDLLRELSPPPDCIISDFLFPWTTDVARRLNIPRLVFNGPGCFYLLCIHVAITSNILGENEPVSSNTERVVLPGLPDRIEVTKLQIVGSSRPANVDEMGSWLRAVEAEKASFGIVVNTFEELEPEYVEEYKTVKDKKMWCIGPVSLCNKTGPDLAERGNKAAITEHNCLKWLDERKLGSVLYVCLGSLARISAAQAIELGLGLESINRPFIWCVRNETDELKTWFLDGFEERVRDRGLIVHGWAPQVLILSHPTIGGFLTHCGWNSTIESITAGVPMITWPFFADQFLNEAFIVEVLKIGVRIGVERACLFGEEDKVGVLVKKEDVKKAVECLMDEDEDGDQRRKRVIELAKMAKIAMAEGGSSYENVSSLIRDVTETVRAPH

SEQ ID NO: 127 - DNA, 1272 bp, Stevia rebaudiana
  CDS (1)..(1272)
atgttgcaattggctacctacttgcactctcaaggtatctccatcactattgctcaatacccaaacttcaactctccagactcctccaaccacccagaattgactttcttaccattatcttccggtaacttgtccgttgctgatatctctggtggtttcttcaaattcattcaaaccttgaaccacaactgtaagcctcacttcagagaatacttggttcaaaacatgtcctctgatgacaaggaatccattgtcatcatcagagacaacttgatgttctttgctggtgaaatcgctggtgaattaggtttaccatctatcatcttgagaggttctaacgctgtcatgttgactgcttccgatatcattccacaattgcaccaagaaggtagattcccaccaccagactctctattgcaagaaaccattccagaattggttccattcagatacaaggacttgccattcatcggttacccaattcaccaaaccttggaattctccattaccatgatgaccccaaagtctccagcttctgccatcttgatcaacactttagaattcttggaacaatctgctttgactcaaatccgtgaccactacaaggtcccagttttcactatcggtccattgcacaagattgtcactaccagatccacttccatcttggaagaagacacctcttgtatcaactggttggacaagcaatctccaaagtctgttgtctacgtttctctaggttctttggccaaattggacgaaaaggttgcttctgaaatggcttgtggtttggccatgtccaaccataaattcttatgggttgtcagaccaggtatggtccatggtttcgaatgggttgaatttttgccagactctttggttggtgaaatgaaggccagaggtttgattgtcaaatgggctccacaaaccactgttttggctcacaacgctgtcggtggtttttggtcccactgtggttggaactctactatcgaatgtttggctgaaggtgttccaatgatgtgtcaacctttcttcgctgaccaattgttgaatgctcgttacgtttccgatgtctggaagaccggtttcgaaattgtcattgaaaagggtgaaattgcttgtgccatcaagagagttttggtcgatgaagaaggtgaagaaatgagacaaagagctatggaaatcaaggaaaaggtcaagattgccatcaacgatggtggttcttcttacgactctttcaaggatttggttgctttcatctcctctttg

SEQ ID NO: 128 - protein, 424 aa, Stevia rebaudiana
MLQLATYLHSQGISITIAQYPNFNSPDSSNHPELTFLPLSSGNLSVADISGGFFKFIQTLNHNCKPHFREYLVQNMSSDDKESIVIIRDNLMFFAGEIAGELGLPSIILRGSNAVMLTASDIIPQLHQEGRFPPPDSLLQETIPELVPFRYKDLPFIGYPIHQTLEFSITMMTPKSPASAILINTLEFLEQSALTQIRDHYKVPVFTIGPLHKIVTTRSTSILEEDTSCINWLDKQSPKSVVYVSLGSLAKLDEKVASEMACGLAMSNHKFLWVVRPGMVHGFEWVEFLPDSLVGEMKARGLIVKWAPQTTVLAHNAVGGFWSHCGWNSTIECLAEGVPMMCQPFFADQLLNARYVSDVWKTGFEIVIEKGEIACAIKRVLVDEEGEEMRQRAMEIKEKVKIAINDGGSSYDSFKDLVAFISSL

SEQ ID NO: 129 - DNA, 1422 bp, Stevia rebaudiana
  CDS (1)..(1422)
atgtctacctctgaattggttttcattccatctccaggtgctggtcatttgccaccaactgttgaattggccaaattgttgttgcaccgtgaccaaagattgtctgtcaccatcattgtcatgaacttatggttaggtccaaagcacaacactgaagccagaccatgtgttccttccttgagattcgtcgatatcccatgtgacgaatctaccatggctttgatctctccaaacactttcatctctgcctttgtcgaacaccacaagccaagagttcgtgacatcgttcgtggtatcattgaatctgactctgtcagattggctggtttcgtcttggacatgttctgtatgccaatgtccgatgttgctaacgaatttggtgttccatcttacaactacttcacctctggtgctgccactttaggtttgatgttccatttgcaatggaagagagatcacgaaggttacgacgctactgaattgaagaactctgacactgaattatctgtcccatcttacgttaaccctgttccagccaaggtcttgccagaagttgttttggacaaggaaggtggttccaagatgttcttggatttggctgaaagaatcagagaatccaagggtatcatcgttaactcttgtcaagctattgaaagacacgctttggaatacctatcctccaacaacaacggtattccacctgttttcccagtcggtccaatcttgaacttggaaaacaagaaggacgatgctaagactgacgaaatcatgagatggttgaacgaacaaccagaatcctctgttgttttcttgtgtttcggttccatgggttctttcaacgaaaagcaagtcaaagaaattgctgttgccattgaaagatctggtcacagatttttatggtctttgagaagaccaactccaaaggaaaagattgaattcccaaaggaatacgaaaacttggaagaagtcttaccagaaggtttcttgaagagaacctcttctatcggtaaggttatcggttgggctccacaaatggctgtcttgtcccacccatccgtcggtggtttcgtttcccactgtggttggaactccactttggaatccatgtggtgtggtgtcccaatggctgcttggccattatacgctgaacaaactttgaatgctttcttgttggttgtcgaattgggtttggctgctgaaattagaatggactacagaaccgataccaaggctggttacgatggtggtatggaagtcaccgttgaagaaattgaagacggtatcagaaagttgatgtctgacggtgaaatcagaaacaaggtcaaggatgtcaaggaaaaatccagagctgccgttgttgagggtggttcttcttacgcttccattggtaaattcatcgaacacgtttccaacgtcaccata

SEQ ID NO: 130 - protein, 474 aa, Stevia rebaudiana
MSTSELVFIPSPGAGHLPPTVELAKLLLHRDQRLSVTIIVMNLWLGPKHNTEARPCVPSLRFVDIPCDESTMALISPNTFISAFVEHHKPRVRDIVRGIIESDSVRLAGFVLDMFCMPMSDVANEFGVPSYNYFTSGAATLGLMFHLQWKRDHEGYDATELKNSDTELSVPSYVNPVPAKVLPEVVLDKEGGSKMFLDLAERIRESKGIIVNSCQAIERHALEYLSSNNNGIPPVFPVGPILNLENKKDDAKTDEIMRWLNEQPESSVVFLCFGSMGSFNEKQVKEIAVAIERSGHRFLWSLRRPTPKEKIEFPKEYENLEEVLPEGFLKRTSSIGKVIGWAPQMAVLSHPSVGGFVSHCGWNSTLESMWCGVPMAAWPLYAEQTLNAFLLVVELGLAAEIRMDYRTDTKAGYDGGMEVTVEEIEDGIRKLMSDGEIRNKVKDVKEKSRAAVVEGGSSYASIGKFIEHVSNVTI

SEQ ID NO: 131 - DNA, 1437 bp, Stevia rebaudiana
  CDS (1)..(1437)
atggcctccattgctgaaatgcaaaagcctcatgccatctgtatcccatacccagctcaaggtcacatcaacccaatgatgcaatttgccaaattgttgcacttcaagggtttccacatctctttcgttaacaaccattacaaccacaagagattacaaagatctagaggtctatccgctttggaaggtttgccagacttccacttctactccatcccagatggtttgcctccatctaacgctgaagctactcaatccattccaggtctatgtgaatctattccaaagcactctttggaaccattctgtgacttgattgccactttgaatggttctgatgttccaccagtctcctgtatcatctctgacggtgtcatgtctttcactttgcaagctgctgaaagattcggtttaccagaagtcttattctggactccatctgcttgtggtttcttggcttacactcactacagagatttggttgacaaagaatacattccattgaaggacaccaatgatttgaccaacggttacttggaaacttctttggactggatcccaggtatgaagaacatcagattaaaggacttcccatctttcatcagaaccaccgatatcaacgatatcatgttgaactacttcttgattgaaactgaagccattccaaagggtgttgccatcatcttgaacactttcgatgctttggaaaaggactctatcactccagtcttggctttgaaccctcaaatctacaccatcggtccattgcacatgatgcaacaatacgtcgaccatgatgaaagattgaagcacattggttccaacttatggaaggaagacgtttcttgtatcaactggttggacaccaagaagccaaactccgttgtctacgtcaactttggttccatcactgttatgaccaaggaacaattgattgaattcggttggggtttggctaactctaagaaggacttcttatggatcaccagaccagacattgttggtggtaacgaagctatgattccagctgaattcattgaagaaaccaaggaaagaggtatggttacttcctggtgttcccaagaagaagttttgaagcacccatccattggtgttttcttgacccactctggttggaactccaccattgaatccatctctaacggtgttccaatgatctgttggccattcttcgctgaacaacaaaccaactgtcgttactgttgtgtcgaatgggaaatcggtttggaaattgacactgacgtcaagcgtgaagaagttgaagctcaagttagagaaatgatggatggttctaagggtaagatgatgaaaaacaaggctttggaatggaagaagaaggctgaagaagctgtctctattggtggttcttcttacttgaactttgaaaaattggtcaccgatgtcttgttgcgcaaa

SEQ ID NO: 132 - protein, 479 aa, Stevia rebaudiana
MASIAEMQKPHAICIPYPAQGHINPMMQFAKLLHFKGFHISFVNNHYNHKRLQRSRGLSALEGLPDFHFYSIPDGLPPSNAEATQSIPGLCESIPKHSLEPFCDLIATLNGSDVPPVSCIISDGVMSFTLQAAERFGLPEVLFWTPSACGFLAYTHYRDLVDKEYIPLKDTNDLTNGYLETSLDWIPGMKNIRLKDFPSFIRTTDINDIMLNYFLIETEAIPKGVAIILNTFDALEKDSITPVLALNPQIYTIGPLHMMQQYVDHDERLKHIGSNLWKEDVSCINWLDTKKPNSVVYVNFGSITVMTKEQLIEFGWGLANSKKDFLWITRPDIVGGNEAMIPAEFIEETKERGMVTSWCSQEEVLKHPSIGVFLTHSGWNSTIESISNGVPMICWPFFAEQQTNCRYCCVEWEIGLEIDTDVKREEVEAQVREMMDGSKGKMMKNKALEWKKKAEEAVSIGGSSYLNFEKLVTDVLLRK

SEQ ID NO: 133 - DNA, 1374 bp, Stevia rebaudiana
  CDS (1)..(1374)
atggaaaacaagactgaaactaccgttcgtcgtagaagaagaatcatcttattcccagttccagttcaaggtcacatcaacccaattttgcaattggctaacgtcttatactccaagggtttctccatcactattttccacactaacttcaacaagccaaagacctccaactacccacacttcaccttcagatttattttggacaatgaccctcaagatgtcagaatctccaacttgccaactcacggtccattgaccgtcatgagaattttgatcatcaacgaacacggtgctgatgaattgcaaagagaattggaattgttgatgttggcctccgaagaagacggtgaagtctcctgtttgattaccgaccaaatctggtacttcacccaatctgttgctgactctttgaacttgagaagattggttttgatgacttcttctttgttcaacttccacgctcatgtttctttgcctcaattcgatgaattgggttacttggacccagacgacaagactagattagaagaacaagcttctggtttcccaatgttgaaggtcaaggatatcaaatgtggtttctctatgtggaagcaaggtaaggaaatctttgaaaacatcaccaagcaaaccaaggcttcttctggtgtcatctggaactctttcaaggaattggaagaatctgaattggaaaccgtcatcagagaaatcccagctccatccttcttgattccattgccaaagcatttgactgcttcctcttcttctctattagaccacgacagaactgttttcccatggttagaccaacaaccatctcgttctgtcttgtacgtttctttcggttctgctactgaagtcgatgctaaggacttcttggaaattgctcgtggtttggtcgactccaagcaatctttcttatgggttgttagaccaggtttcgtcaagggttccacctgggttgaaccattgccagatggtttcttgggtgaaagaggtagaattgtcaaatgggttccacaacaagaagttttggctcacggtgccattggtgctttctggacccactctggttggaactccactttggaatccgtttgtgaaggtgttccaatgattttctctgcctttgcctttgaccaaccattaaacgctagatacatgtccgatgtcttgaaggttggtgtctacttggaaaacggttgggaaagaggtgaaattgccaacgccatcagaagagttatggtcgatgaagaaggtggttacatcagacaaaacgcttccgtcttgaagcaaaaggctgatgtttccttgatgaagggtggttcttcttacgaatctctagaatctttggttgcttacatctccagctta

SEQ ID NO: 134 - protein, 458 aa, Stevia rebaudiana
MENKTETTVRRRRRIILFPVPVQGHINPILQLANVLYSKGFSITIFHTNFNKPKTSNYPHFTFRFILDNDPQDVRISNLPTHGPLTVMRILIINEHGADELQRELELLMLASEEDGEVSCLITDQIWYFTQSVADSLNLRRLVLMTSSLFNFHAHVSLPQFDELGYLDPDDKTRLEEQASGFPMLKVKDIKCGFSMWKQGKEIFENITKQTKASSGVIWNSFKELEESELETVIREIPAPSFLIPLPKHLTASSSSLLDHDRTVFPWLDQQPSRSVLYVSFGSATEVDAKDFLEIARGLVDSKQSFLWVVRPGFVKGSTWVEPLPDGFLGERGRIVKWVPQQEVLAHGAIGAFWTHSGWNSTLESVCEGVPMIFSAFAFDQPLNARYMSDVLKVGVYLENGWERGEIANAIRRVMVDEEGGYIRQNASVLKQKADVSLMKGGSSYESLESLVAYISSL

SEQ ID NO: 135 - DNA, 1377 bp, Stevia rebaudiana
  CDS (1)..(1377)
atggaaaacaagactgaaactactgtcagaagaagacgtcgtatcatcttgttcccagttccattccaaggtcacatcaacccaatgttacaattagctaacgtcttgtactccaagggtttctccatcaccattttccacaccaacttcaacaagccaaagacttctaactacccacacttcactttcagatttatcttggacaacgaccctcaagatgtcagaatttccaacttgccaacccacggtccattggctgtcatgagaattttgatcatcaacgaacacggtgccgacgaattgagaagagaattggaattgttgatgttggcttctgaagaagatggtgaagtttcctgtttgattgctgaccaaatctggtacttcacccaatctgttgctgactctttgaacttgagaagattggtcttggtcacttcttctttgttcaacttccacgctcatgtctctttgccacaatttgacgaattgggttacttggacccagatgacaagaccagattggaagaacaagcttctggtttcccaatgttgaaggttaaggatatcaaatgttctttctccatgtggaagaaatacaaggaatactttgaaaacatcaccaagcaaaccaaggcctcctccggtgttatctggaactctttcaaggaattagaagaatctgaattggaaactgttatcagagaaattccagctccatctttcttaatcccattaccaaagcatttgactgcttcttcttcctctttgttggaccacgacagaaccgttttcccatggttggaccaacaaccatccagatctgtcttgtacgtttctttcggttctggtactgaagtcttagatgaaaaggacttcttggaaattgccagaggtttagtcgactccaagcaatctttcttgtgggttgttagaccaggtttcgtcaagggttccacctgggttgaaccattgccagatggtttcttgggtgaaagaggtagaattgtcaaatgggttcctcaacaagaagttttggctcacggtgccattggtgctttctggacccactctggttggaactccactttggaatctgtttgtgaaggtgttccaatgattttctccgatttcggtctagaccaaccattgaacgctcgttacatgtccgatgttttgaaggttggtgtctacttggaaaacggttgggaaagaggtgaaattgctaacgccatcagaagagtcatggttgacgaagaaggtgaatacatcagacaaaatgctcgtgtcttgaaacaaaaggctgatgtttctttgatgaagggtggttcttcttacgaatccttggaatctttagtctcttacatctcctcctta

SEQ ID NO: 136 - protein, 459 aa, Stevia rebaudiana
MENKTETTVRRRRRIILFPVPFQGHINPMLQLANVLYSKGFSITIFHTNFNKPKTSNYPHFTFRFILDNDPQDVRISNLPTHGPLAVMRILIINEHGADELRRELELLMLASEEDGEVSCLIADQIWYFTQSVADSLNLRRLVLVTSSLFNFHAHVSLPQFDELGYLDPDDKTRLEEQASGFPMLKVKDIKCSFSMWKKYKEYFENITKQTKASSGVIWNSFKELEESELETVIREIPAPSFLIPLPKHLTASSSSLLDHDRTVFPWLDQQPSRSVLYVSFGSGTEVLDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 137 - DNA, 1419 bp, Stevia rebaudiana
  CDS (1)..(1419)
atggctacttctgactccattgtcgatgacagaaagcaattgcacgttgccactttcccatggttggctttcggtcacattttgccattcttgcaattgtccaaattgattgctgaaaagggtcacaaggtttctttcttgtccactaccagaaacatccaaagattatcttctcacatctctccattgatcaacgttgtccaattgactttgccaagagtccaagaattgccagaagatgctgaagctaccaccgatgtccacccagaagatatccaatacttgaagaaggctgtcgatggtttgcaaccagaagtcaccagattcttggaacaacactctccagactggatcatctacgacttcacccactactggttaccatccattgctgcttctttgggtatctccagagcttacttctgtgtcatcactccatggaccattgcttacttggctccatcttctgatgccatgatcaacgactctgacggtagaaccactgttgaagatttgaccactccacctaaatggttcccattcccaaccaaggtttgttggagaaagcatgacttggccagaatggaaccttacgaagctccaggtatttctgatggttacagaatgggtatggttttcaagggttctgactgtctattattcaaatgttaccatgaattcggtactcaatggttgccattgttggaaactttgcaccaagttccagttgttccagtcggtttgttgccaccagaaattccaggtgatgaaaaggatgaaacctgggtttccatcaagaaatggttggacggtaagcaaaagggttccgttgtctacgttgctttgggttctgaagctttggtttctcaaactgaagttgtcgaattggctttgggtctagaattgtccggtttaccatttgtctgggcttacagaaagccaaagggtccagccaaatctgattccgtcgaattaccagacggtttcgtcgaaagaacccgtgaccgtggtttagtctggacttcctgggctccacaattgagaatcttgtcccacgaatccgtttgtggtttcttgactcactgtggttctggttctattgtcgaaggtttgatgttcggtcacccattgattatgttgcctttgtttggtgaccaaccattaaacgctagattattggaagacaagcaagtcggtatcgaaattccaagaaacgaagaagacggttgtttgaccaaggaatccgttgctcgttctttgagatccgttgttgtcgaaaacgaaggtgaaatctacaaggccaacgccagagaattgtctaagatctacaacgacaccaaggttgaaaaggaatacgtttctcaatttgtcgactacttggaaaagaacgctagagctgttgccatcgaccacgaaagc

SEQ ID NO: 138 - protein, 473 aa, Stevia rebaudiana; identical to SEQ ID NO: 110

SEQ ID NO: 139 - DNA, 1419 bp, Stevia rebaudiana
  CDS (1)..(1419)
atggctacctctgactccattgtcgatgaccgtaaacaattgcacgttgctactttcccatggttggctttcggtcacatcttgccttacttgcaattgtccaagttgattgctgaaaagggtcacaaggtttctttcttgtccactactagaaacatccaaagattatcttctcacatctctccattgatcaacgttgtccaattgactttgccaagagttcaagaattaccagaagatgctgaagctaccaccgatgtccacccagaagacattccatacttgaagaaggcctctgacggtttgcaaccagaagtcactagattcttggaacaacactctccagactggatcatctacgactacactcactactggttgccatccattgctgcttctttgggtatctccagagcccatttctccgtcaccactccatgggctattgcttacatgggtccatctgctgatgctatgatcaacggttctgacggtagaaccaccgtcgaagatttgactaccccacctaaatggttcccattcccaaccaaggtttgttggagaaagcatgatttggccagattagtcccatacaaggctccaggtatttctgatggttacagaatgggtttggtcttgaaaggttctgactgtttgttgtccaaatgttaccacgaattcggtactcaatggttaccattgttggaaactttgcaccaagttccagttgttccagtcggtttgttgcctccagaagttccaggtgacgaaaaggatgaaacctgggtttccatcaagaaatggttggatggtaagcaaaagggttccgttgtctacgttgctttgggttctgaagtcttggtcagccaaactgaagttgtcgaattggctttaggtttggaattgtccggtctaccatttgtctgggcttacagaaagccaaagggtccagctaagtctgactccgttgaattgccagatggtttcgtcgaaagaaccagagacagaggtttggtttggacttcttgggctccacaattgagaatcttatctcacgaatctgtttgtggtttcttgacccactgtggttctggttccatcgtcgaaggtttgatgttcggtcacccattaatcatgttgccaattttcggtgaccaaccattgaacgccagattattggaagacaagcaagtcggtattgaaattccaagaaacgaagaagatggttgtttgaccaaggaatccgttgccagatctctacgttctgttgttgtcgaaaaggaaggtgaaatctacaaggccaacgctcgtgaattatccaagatctacaacgacaccaaggttgaaaaggaatacgtttctcaatttgttgactacttggaaaagaacactagagctgttgccattgaccatgagtct

SEQ ID NO: 140 - protein, 473 aa, Stevia rebaudiana; identical to SEQ ID NO: 106

SEQ ID NO: 141 - DNA, 2361 bp, Stevia rebaudiana
atgaaaaccggtttcatctctcccgccactgttttccaccaccgaatctcccccgccaccaccttccgacaccacctctcccctgccaccaccaactccactggtattgttgctctgcgagacatcaacttccgatgcaaggctgtttccaaggagtactccgatctgctccagaaggacgaggcctctttcaccaagtgggacgacgacaaggtcaaggaccacctcgacaccaacaagaacctctaccccaacgacgagatcaaggagtttgtcgagtccgtcaaggccatgttcggctccatgaacgacggcgagattaatgtctctgcttacgacaccgcctgggttgctctggtccaggatgtcgacggttccggctctcctcagttcccttcctctctcgagtggatcgccaacaaccagctgtccgacggttcttggggtgaccacctgctcttctctgctcacgaccgaatcatcaacaccctggcctgtgtcattgctctgacctcttggaacgtccacccctccaagtgcgagaagggtctgaacttcctccgagagaacatctgcaagctcgaggacgagaacgccgagcacatgcccattggcttcgaggtcaccttcccctctctgattgacattgccaagaagctcaacattgaggtccccgaggacacccccgctctcaaggagatctacgctcgacgagacatcaagctcaccaagatccccatggaggttctccacaaggtccccaccactctcctccactctctcgagggtatgcccgatctcgagtgggagaagctgctcaagctgcagtgcaaggacggctctttcctcttctccccctcttccactgccttcgccctcatgcagaccaaggacgagaagtgtctccagtacctcaccaacattgtcaccaagttcaacggtggtgtccccaacgtctaccccgttgacctctttgagcacatctgggttgttgaccgactccagcgactcggtatcgcccgatacttcaagtccgagatcaaggactgtgtcgagtacatcaacaagtactggaccaagaacggtatctgctgggcccgaaacacccacgtccaggacattgacgacaccgccatgggcttccgagttctgcgagcccacggctacgatgtcacccccgatgtctttcgacagtttgagaaggacggcaagtttgtctgtttcgccggtcagtccacccaggccgtcaccggtatgttcaacgtctaccgagcttctcagatgctcttccccggtgagcgaatcctcgaggacgccaagaagttctcctacaactacctcaaggagaagcagtccaccaacgagctgctcgacaagtggatcattgccaaggatctgcccggtgaggttggctacgccctcgacatcccctggtacgcctctctgccccgactggagactcgatactacctcgagcagtacggtggtgaggacgatgtctggatcggtaagaccctgtaccgaatgggctacgtttccaacaacacctacctcgagatggccaagctcgactacaacaactacgttgccgtcctccagctcgagtggtacaccatccagcagtggtacgtcgacattggtatcgagaagttcgagtccgacaacatcaagtccgtccttgtctcctactacctcgctgctgcctccatcttcgagcccgagcgatccaaggagcgaattgcctgggccaagaccaccatcctcgtcgacaagatcacctccatcttcgactcctcccagtcctccaaggaagatatcaccgccttcattgacaagttccgaaacaagtcctcctccaagaagcactccatcaacggcgagccctggcacgaggtcatggttgctctcaagaaaactctccacggctttgccctcgacgctctgatgacccactctcaggacatccacccccagctccaccaggcctgggagatgtggctcaccaagctccaggacggtgttgatgtcactgctgagctcatggtccagatgatcaacatgaccgccggccgatgggtttccaaggagctcctcacccacccccagtaccagcgactctccactgtcaccaactctgtctgccacgacatcaccaagctccacaacttcaaggagaactccaccaccgtcgactccaaggtccaggagctggtccagctcgttttctccgacacccccgatgatctcgaccaggacatgaagcagaccttcctgactgtcatgaaaactttctactacaaggcctggtgcgaccccaacaccatcaacgaccacatctccaaggtctttgagattgtgatt

SEQ ID NO: 142 - DNA, 2229 bp, Stevia rebaudiana
atgtgcaaggctgtttccaaggagtactccgatctgctccagaaggacgaggcctctttcaccaagtgggacgacgacaaggtcaaggaccacctcgacaccaacaagaacctctaccccaacgacgagatcaaggagtttgtcgagtccgtcaaggccatgttcggctccatgaacgacggcgagattaatgtctctgcttacgacaccgcctgggttgctctggtccaggatgtcgacggttccggctctcctcagttcccttcctctctcgagtggatcgccaacaaccagctgtccgacggttcttggggtgaccacctgctcttctctgctcacgaccgaatcatcaacaccctggcctgtgtcattgctctgacctcttggaacgtccacccctccaagtgcgagaagggtctgaacttcctccgagagaacatctgcaagctcgaggacgagaacgccgagcacatgcccattggcttcgaggtcaccttcccctctctgattgacattgccaagaagctcaacattgaggtccccgaggacacccccgctctcaaggagatctacgctcgacgagacatcaagctcaccaagatccccatggaggttctccacaaggtccccaccactctcctccactctctcgagggtatgcccgatctcgagtgggagaagctgctcaagctgcagtgcaaggacggctctttcctcttctccccctcttccactgccttcgccctcatgcagaccaaggacgagaagtgtctccagtacctcaccaacattgtcaccaagttcaacggtggtgtccccaacgtctaccccgttgacctctttgagcacatctgggttgttgaccgactccagcgactcggtatcgcccgatacttcaagtccgagatcaaggactgtgtcgagtacatcaacaagtactggaccaagaacggtatctgctgggcccgaaacacccacgtccaggacattgacgacaccgccatgggcttccgagttctgcgagcccacggctacgatgtcacccccgatgtctttcgacagtttgagaaggacggcaagtttgtctgtttcgccggtcagtccacccaggccgtcaccggtatgttcaacgtctaccgagcttctcagatgctcttccccggtgagcgaatcctcgaggacgccaagaagttctcctacaactacctcaaggagaagcagtccaccaacgagctgctcgacaagtggatcattgccaaggatctgcccggtgaggttggctacgccctcgacatcccctggtacgcctctctgccccgactggagactcgatactacctcgagcagtacggtggtgaggacgatgtctggatcggtaagaccctgtaccgaatgggctacgtttccaacaacacctacctcgagatggccaagctcgactacaacaactacgttgccgtcctccagctcgagtggtacaccatccagcagtggtacgtcgacattggtatcgagaagttcgagtccgacaacatcaagtccgtccttgtctcctactacctcgctgctgcctccatcttcgagcccgagcgatccaaggagcgaattgcctgggccaagaccaccatcctcgtcgacaagatcacctccatcttcgactcctcccagtcctccaaggaagatatcaccgccttcattgacaagttccgaaacaagtcctcctccaagaagcactccatcaacggcgagccctggcacgaggtcatggttgctctcaagaaaactctccacggctttgccctcgacgctctgatgacccactctcaggacatccacccccagctccaccaggcctgggagatgtggctcaccaagctccaggacggtgttgatgtcactgctgagctcatggtccagatgatcaacatgaccgccggccgatgggtttccaaggagctcctcacccacccccagtaccagcgactctccactgtcaccaactctgtctgccacgacatcaccaagctccacaacttcaaggagaactccaccaccgtcgactccaaggtccaggagctggtccagctcgttttctccgacacccccgatgatctcgaccaggacatgaagcagaccttcctgactgtcatgaaaactttctactacaaggcctggtgcgaccccaacaccatcaacgaccacatctccaaggtctttgagattgtgatt

SEQ ID NO: 143 - DNA, 2352 bp, Stevia rebaudiana
atgaacctgtctctctgtatcgcctctcctctcctcaccaagtccaaccgacccgctgctctgtctgccatccacaccgcctccacctcccacggcggccagaccaaccccaccaacctcatcattgacaccaccaaggagcgaatccagaagcagttcaagaacgtcgagatctccgtttcctcctacgacaccgcctgggtcgccatggtcccctctcccaactcccccaagtctccctgcttccccgagtgtctcaactggctcatcaacaaccagctcaacgacggctcttggggtctggtcaaccacacccacaaccacaaccaccccctcctcaaggactctctctcttccactctcgcctgcattgttgctctcaagcgatggaacgttggcgaggaccagatcaacaagggtctgtctttcattgagtccaacctcgcctccgccaccgagaagtcccagccctcccccattggctttgatatcatcttccccggtctgctcgagtacgccaagaacctcgatatcaacctgctctccaagcagaccgacttctctctcatgctgcacaagcgagagctcgagcagaagcgatgccactccaacgagatggacggctacctggcctacatttccgagggtctgggtaacctctacgactggaacatggtcaagaagtaccagatgaagaacggttccgttttcaactccccctctgccaccgctgctgccttcatcaaccaccagaaccccggctgtctcaactacctcaactctctgctcgacaagtttggtaacgccgtccccactgtctacccccacgatctcttcatccgactctccatggtcgacaccattgagcgactcggtatttcccaccacttccgagtcgagatcaagaacgttctcgatgagacttaccgatgctgggttgagcgagatgagcagatcttcatggacgttgtcacctgtgctctggccttccgactcctccgaatcaacggttacgaggtttcccccgaccccctcgccgagatcaccaacgagctggctctcaaggacgagtacgccgccctcgagacttaccacgcttctcacattctgtaccaagaggatctgtcctccggcaagcagattctcaagtccgccgacttcctcaaggagatcatctccactgactccaaccgactctccaagctcatccacaaggaagtcgagaacgctctcaagttccccatcaacaccggtctggagcgaatcaacacccgacgaaacatccagctctacaacgtcgacaacacccgaattctcaagaccacctaccactcttccaacatctccaacaccgactacctgcgactcgccgtcgaggacttctacacctgccagtccatctaccgagaggagctcaagggtctggagcgatgggttgtcgagaacaagctcgaccagctcaagtttgcccgacaaaagactgcctactgctacttctccgttgctgccaccctctcttctcccgagctctccgacgcccgaatctcttgggccaagaacggtatcctgaccactgttgtcgacgacttctttgacattggtggcaccattgacgagctgaccaacctcatccagtgcgtcgagaagtggaacgtcgacgttgacaaggactgttgttccgagcacgtccgaatcctcttcctggctctcaaggacgccatctgctggatcggtgacgaggccttcaagtggcaggctcgagatgtcacttcccacgtcatccagacctggctcgagctcatgaactccatgctgcgagaggccatctggacccgagatgcctacgtccccaccctcaacgagtacatggagaacgcctacgtcagctttgctctcggtcccattgtcaagcccgccatctactttgtcggtcccaagctgtccgaggagattgtcgagtcctccgagtaccacaacctcttcaagctcatgtccacccagggccgactcctcaacgatatccactccttcaagcgagagttcaaggaaggtaagctcaacgccgttgctctgcacctgtccaacggtgagtccggcaaggtcgaggaagaggtcgtcgaggagatgatgatgatgatcaagaacaagcgaaaggagctcatgaagctcatcttcgaggagaacggctccattgtcccccgagcctgcaaggacgccttctggaacatgtgccacgtcctcaacttcttctacgccaacgacgacggtttcaccggcaacaccattctcgacaccgtcaaggacatcatctacaaccctctggttctggtcaacgagaacgaggagcagagg

SEQ ID NO: 144 - DNA, 2271 bp, Stevia rebaudiana
atgacctcccacggcggccagaccaaccccaccaacctcatcattgacaccaccaaggagcgaatccagaagcagttcaagaacgtcgagatctccgtttcctcctacgacaccgcctgggtcgccatggtcccctctcccaactcccccaagtctccctgcttccccgagtgtctcaactggctcatcaacaaccagctcaacgacggctcttggggtctggtcaaccacacccacaaccacaaccaccccctcctcaaggactctctctcttccactctcgcctgcattgttgctctcaagcgatggaacgttggcgaggaccagatcaacaagggtctgtctttcattgagtccaacctcgcctccgccaccgagaagtcccagccctcccccattggctttgatatcatcttccccggtctgctcgagtacgccaagaacctcgatatcaacctgctctccaagcagaccgacttctctctcatgctgcacaagcgagagctcgagcagaagcgatgccactccaacgagatggacggctacctggcctacatttccgagggtctgggtaacctctacgactggaacatggtcaagaagtaccagatgaagaacggttccgttttcaactccccctctgccaccgctgctgccttcatcaaccaccagaaccccggctgtctcaactacctcaactctctgctcgacaagtttggtaacgccgtccccactgtctacccccacgatctcttcatccgactctccatggtcgacaccattgagcgactcggtatttcccaccacttccgagtcgagatcaagaacgttctcgatgagacttaccgatgctgggttgagcgagatgagcagatcttcatggacgttgtcacctgtgctctggccttccgactcctccgaatcaacggttacgaggtttcccccgaccccctcgccgagatcaccaacgagctggctctcaaggacgagtacgccgccctcgagacttaccacgcttctcacattctgtaccaagaggatctgtcctccggcaagcagattctcaagtccgccgacttcctcaaggagatcatctccactgactccaaccgactctccaagctcatccacaaggaagtcgagaacgctctcaagttccccatcaacaccggtctggagcgaatcaacacccgacgaaacatccagctctacaacgtcgacaacacccgaattctcaagaccacctaccactcttccaacatctccaacaccgactacctgcgactcgccgtcgaggacttctacacctgccagtccatctaccgagaggagctcaagggtctggagcgatgggttgtcgagaacaagctcgaccagctcaagtttgcccgacaaaagactgcctactgctacttctccgttgctgccaccctctcttctcccgagctctccgacgcccgaatctcttgggccaagaacggtatcctgaccactgttgtcgacgacttctttgacattggtggcaccattgacgagctgaccaacctcatccagtgcgtcgagaagtggaacgtcgacgttgacaaggactgttgttccgagcacgtccgaatcctcttcctggctctcaaggacgccatctgctggatcggtgacgaggccttcaagtggcaggctcgagatgtcacttcccacgtcatccagacctggctcgagctcatgaactccatgctgcgagaggccatctggacccgagatgcctacgtccccaccctcaacgagtacatggagaacgcctacgtcagctttgctctcggtcccattgtcaagcccgccatctactttgtcggtcccaagctgtccgaggagattgtcgagtcctccgagtaccacaacctcttcaagctcatgtccacccagggccgactcctcaacgatatccactccttcaagcgagagttcaaggaaggtaagctcaacgccgttgctctgcacctgtccaacggtgagtccggcaaggtcgaggaagaggtcgtcgaggagatgatgatgatgatcaagaacaagcgaaaggagctcatgaagctcatcttcgaggagaacggctccattgtcccccgagcctgcaaggacgccttctggaacatgtgccacgtcctcaacttcttctacgccaacgacgacggtttcaccggcaacaccattctcgacaccgtcaaggacatcatctacaaccctctggttctggtcaacgagaacgaggagcagagg

SEQ ID NO: 145 - DNA, 1539 bp, Stevia rebaudiana
atggacgccgtcactggtctgctcaccgtccccgccactgccatcaccatcggtggtactgccgttgctctggccgttgctctcatcttctggtacctcaagtcctacacctctgcccgacgatcccagtccaaccacctcccccgagtccccgaggtccccggtgtccccctgctcggtaacctgctccagctcaaggagaagaagccctacatgaccttcacccgatgggctgccacctacggccccatctactccatcaagactggtgccacctccatggttgttgtctcttccaacgagattgctaaagaggctctcgtcacccgattccagtccatctccacccgaaacctctccaaggctctcaaggttctgaccgccgacaagaccatggttgccatgtccgactacgacgactaccacaagaccgtcaagcgacacattctcaccgccgttctcggccccaacgcccagaagaagcaccgaatccaccgagacatcatgatggacaacatctccacccagctccacgagtttgtcaagaacaaccccgagcaggaagaggttgatctccgaaagatcttccagtccgagctcttcggtctggccatgcgacaggctctgggcaaggatgtcgagtctctctacgtcgaggatctcaagatcaccatgaaccgagatgagatcttccaggttctggttgtcgaccccatgatgggtgccattgatgtcgactggcgagacttcttcccctacctcaagtgggtccccaacaagaagtttgagaacaccatccagcagatgtacatccgacgagaggctgtcatgaagtctctcatcaaggagaacaagaagcgaattgcctccggtgagaagctcaactcctacattgactacctgctctccgaggcccagaccctcaccgaccagcagctgctcatgtctctgtgggagcccatcattgagtcctccgacaccaccatggtcaccaccgagtgggccatgtacgagctcgccaagaaccccaagctccaggaccgactctaccgagacatcaagtctgtctgtggctccgagaagatcaccgaggagcacctgtcccagctcccctacatcactgccatcttccacgagactctccgacgacactctcccgtccccatcatccctctccgacacgtccacgaggacaccgttctgggtggctaccacgtccccgccggtaccgagctcgctgtcaacatctacggctgcaacatggacaagaacgtctgggagaaccccgaggagtggaaccccgagcgattcatgaaggagaacgagactattgacttccagaaaaccatggcctttggtggtggcaagcgagtctgcgccggctctctccaggctctgctgaccgcctccattggtattggccgaatggtccaggagttcgagtggaagctcaaggacatgacccaggaagaggtcaacaccattggcctcaccacccagatgctccgacctctccgagccatcatcaagccccgaata

SEQ ID NO: 146 - DNA, 1566 bp, Stevia rebaudiana
atgggtctgttccccctcgaggactcctacgctctggtctttgagggcctcgccatcaccctcgccctctactacctgctctccttcatctacaagacctccaagaaaacctgcactcctcccaaggcctccggtgagcaccccatcaccggccacctcaacctgctctccggctcttccggcctcccccacctcgccctcgcctctctggctgaccgatgtggtcccatcttcaccatccgactcggtatccgacgagtcctcgttgtctccaactgggagattgccaaggagatcttcaccacccacgatctcattgtctccaaccgacccaagtacctggctgccaagattctcggtttcaactacgtttccttctcctttgccccctacggcccctactgggtcggtatccgaaagatcattgccaccaagctcatgtcctcttctcgactccagaagctccagttcgtccgagtctttgagctcgagaactccatgaagtccatccgagagtcttggaaggagaagaaggacgaggaaggcaaggttctggtcgagatgaagaagtggttctgggagctcaacatgaacattgttctgcgaactgttgctggtaagcagtacaccggtaccgtcgacgacgccgatgccaagcgaatctccgagctcttccgagagtggttccactacaccggccgatttgttgtcggtgacgccttccccttcctcggctggctcgatctcggtggctacaagaaaaccatggagctcgtcgcctcccgactcgactccatggtcagcaagtggctcgacgagcaccgaaagaagcaggccaacgacgacaagaaagaggacatggacttcatggacatcatgatctccatgaccgaggccaactctcccctcgagggttacggtaccgacaccatcatcaagaccacctgcatgaccctcattgtctccggtgtcgacaccacctccattgtcctgacctgggctctgtctctgctgctcaacaaccgagacactctcaagaaggcccaggaagagctcgacatgtgtgtcggcaagggccgacaggtcaacgagtccgatctggtcaacctcatctacctcgaggctgttctcaaggaagctctgcgactctaccccgctgccttcctcggtggtccccgagccttcctcgaggactgcactgttgccggctaccgaatccccaagggtacctgtctgctcatcaacatgtggaagctccaccgagatcccaacatctggtccgacccctgcgagttcaagcccgagcgattcctgacccccaaccagaaggacgttgatgtcattggtatggacttcgagctcatccccttcggtgccggccgacgatactgccccggtacccgactcgccctccagatgctgcacattgttctcgccactctgctccagaactttgagatgtccacccccaacgacgcccccgtcgacatgactgcttccgtcggtatgaccaacgccaaggcttctcctctcgaggtcctcctgtctccccgagtcaagtggtca

SEQ ID NO: 147 - DNA, 1443 bp, Stevia rebaudiana
atggacgccatggccaccaccgagaagaagccccacgtcatcttcatccccttccccgcccagtcccacatcaaggccatgctcaagctcgcccagctcctccaccacaagggcctccagatcacctttgtcaacaccgacttcatccacaaccagttcctcgagtcctccggcccccactgtctggacggtgctcccggtttccgatttgagactatccccgatggtgtctcccactcccccgaggcctccatccccatccgagagtctctgctccgatccattgagactaacttcctcgaccgattcattgatctcgtcaccaagctccccgatcctcccacctgtatcatctccgacggtttcctgtccgttttcaccattgatgctgccaagaagctcggtatccccgtcatgatgtactggactctggctgcctgtggtttcatgggtttctaccacatccactctctgatcgagaagggctttgctcctctcaaggacgcctcctacctcaccaacggttacctcgacaccgtcattgactgggtccccggtatggagggtatccgactcaaggacttccccctcgactggtccaccgacctcaacgacaaggttctcatgttcaccaccgaggctccccagcgatcccacaaggtttcccaccacatcttccacaccttcgacgagctcgagccctccatcatcaagactctgtctctgcgatacaaccacatctacaccattggccccctccagctcctcctcgaccagatccccgaggagaagaagcagaccggtatcacctctctgcacggctactctctcgtcaaggaagagcccgagtgcttccagtggctccagtccaaggagcccaactccgttgtctacgtcaactttggctccaccaccgtcatgtctctcgaggacatgaccgagtttggctggggtctggccaactccaaccactacttcctgtggatcatccgatccaacctcgtcattggcgagaacgccgttctgcctcccgagctcgaggagcacatcaagaagcgaggcttcattgcctcttggtgctcccaggagaaggttctcaagcacccctccgtcggtggtttcctgacccactgcggctggggctccaccattgagtctctgtccgctggtgtccccatgatctgctggccctactcctgggaccagctcaccaactgccgatacatctgcaaggagtgggaggttggtctggagatgggtaccaaggtcaagcgagatgaggtcaagcgactcgtccaggagctcatgggcgagggtggtcacaagatgcgaaacaaggccaaggactggaaggagaaggcccgaattgccattgcccccaacggctcttcttctctcaacattgacaagatggtcaaggagatcactgttctcgctcgaaac

SEQ ID NO: 148 - DNA, 1380 bp, Stevia rebaudiana
atggccgagcagcagaagatcaagaagtctccccacgttctgctcatccccttccctctgcagggccacatcaaccccttcatccagttcggcaagcgactcatctccaagggtgtcaagaccactctggtcaccaccatccacaccctcaactccactctcaaccactccaacaccaccaccacctccatcgagatccaggccatctccgacggctgtgacgagggtggtttcatgtctgctggtgagtcttacctcgagactttcaagcaggtcggttccaagtctctggctgacctcatcaagaagctccagtccgagggtaccaccattgacgccatcatctacgactccatgaccgagtgggttctcgatgtcgccatcgagtttggtattgacggtggctccttcttcacccaggcctgtgtcgtcaactctctctactaccacgtccacaagggtctgatctctctgcccctcggcgagactgtctccgtccccggtttccccgttctgcagcgatgggagactcctctcattctccagaaccacgagcagatccagtccccctggtcccagatgctcttcggccagttcgccaacattgaccaggcccgatgggttttcaccaactccttctacaagctcgaggaagaggtcattgagtggacccgaaagatctggaacctcaaggtcattggccccaccctcccctccatgtacctcgacaagcgactcgatgacgacaaggacaacggtttcaacctctacaaggccaaccaccacgagtgcatgaactggctcgacgacaagcccaaggagtccgttgtctacgttgcctttggctctctggtcaagcacggccccgagcaggttgaggagatcacccgagctctgattgactccgatgtcaacttcctgtgggtcatcaagcacaaggaagagggtaagctccccgagaacctgtccgaggtcatcaagaccggcaagggcctcattgttgcctggtgcaagcagctcgacgttctcgcccacgagtccgtcggctgctttgtcacccactgcggtttcaactccaccctcgaggctatctctctcggtgtccccgttgttgccatgccccagttctccgaccagaccaccaacgccaagctcctcgatgagattctcggtgtcggtgtccgagtcaaggctgacgagaacggtattgtccgacgaggtaacctggcttcttgtatcaagatgatcatggaggaagagcgaggtgtcatcatccgaaagaacgccgtcaagtggaaggatctggccaaggttgctgtccacgagggtggctcttccgacaacgacattgtcgagtttgtctccgagctcatcaaggcc

SEQ ID NO: 149 - DNA, 1374 bp, Stevia rebaudiana
atggagaacaagaccgagactaccgtccgacgacgacgacgaatcattctcttccccgtccccttccagggccacatcaaccccattctgcagctcgccaacgttctgtactccaagggcttctccatcaccatcttccacaccaacttcaacaagcccaagacctccaactacccccacttcactttccgattcatcctcgacaacgacccccaggacgagcgaatctccaacctgcccacccacggtcctctggctggtatgcgaatccccatcatcaacgagcacggtgctgacgagctccgacgagagctcgagctgctcatgctcgcctccgaagaggacgaggaagtctcctgtctgatcaccgatgctctgtggtactttgcccagtccgtcgccgactctctcaacctgcgacgactcgttctcatgacctcctctctgttcaacttccacgcccacgtttctctgccccagtttgacgagctcggttacctcgaccccgatgacaagacccgactcgaggagcaggcttccggtttccccatgctcaaggtcaaggacatcaagtccgcctactccaactggcagattctcaaggagattctcggcaagatgatcaagcagaccaaggcctcctccggtgtcatctggaactccttcaaggagctcgaggagtccgagctcgagactgtcatccgagagatccccgctccctctttcctcatccccctgcccaagcacctcaccgcttcctcctcttctctgctcgaccacgaccgaaccgtctttcagtggctcgaccagcagcccccttcctccgtcctctacgtttccttcggctccacctccgaggtcgacgagaaggacttcctcgagattgctcgaggcctcgttgactccaagcagtccttcctgtgggttgtccgacccggctttgtcaagggctccacctgggttgagcccctgcccgatggtttcctcggtgagcgaggccgaattgtcaagtgggtcccccagcaggaagttctggcccacggtgccattggtgccttctggacccactccggctggaactccactctcgagtccgtctgcgagggtgtccccatgatcttctccgactttggcctcgaccagcccctcaacgcccgatacatgtccgatgttctcaaggtcggtgtctacctcgagaacggctgggagcgaggtgagattgccaacgccatccgacgagtcatggtcgacgaggaaggtgagtacatccgacagaacgcccgagtcctcaagcagaaggccgatgtctctctcatgaagggtggttcttcttacgagtctctcgagtctctcgtttcctacatctcttctttg

SEQ ID NO: 150 - DNA, 2130 bp, Stevia rebaudiana
atgcagtccgactccgtcaaggtcagccccttcgatcttgtctccgccgccatgaacggcaaggccatggagaagctcaacgcctccgagtccgaggaccccaccaccctccccgctctcaagatgctcgtcgagaaccgagagctcctcaccctcttcaccacctccttcgccgttctcattggctgtctggtctttctcatgtggcgacgatcttcctccaagaagctcgtccaggaccccgtcccccaggtcattgttgtcaagaagaaggagaaggagtccgaggtcgacgacggcaagaagaaggtttccatcttctacggtactcagaccggtactgccgagggtttcgccaaggctctcgtcgaggaagccaaggtccgatacgaaaagacctccttcaaggtcatcgatctcgatgactacgctgctgacgacgacgagtacgaggagaagctcaagaaggagtctctcgccttcttcttcctggccacctacggtgacggtgagcccactgacaacgccgccaacttctacaagtggttcaccgagggtgacgacaagggcgagtggctcaagaagctccagtacggtgtctttggcctcggtaaccgacagtacgagcacttcaacaagattgccattgttgtcgacgacaagctgaccgagatgggcgccaagcgactcgttcccgtcggcctcggtgatgatgaccagtgtatcgaggacgacttcaccgcctggaaggagctcgtctggcccgagctcgaccagctgctgcgagatgaggacgacacttccgtcaccactccctacaccgctgctgttctcgagtaccgagttgtctaccacgacaagcccgctgactcctacgccgaggaccagacccacaccaacggccacgttgtccacgacgcccagcacccctctcgatccaacgttgccttcaagaaggagctccacacctcccagtccgaccgatcttgcacccacctcgagtttgacatctcccacactggtctgtcttacgaaaccggcgaccacgtcggtgtctactccgagaacctctccgaggttgtcgacgaggctctcaagctgctcggtctgtctcccgacacctacttctccgtccacgccgataaagaggacggcacccccatcggtggtgcttctctgcctcctccctttcccccttgcactctgcgagatgctctgacccgatacgccgacgttctctcttctcccaagaaggttgctctgctggccctcgccgcccacgcctccgacccctccgaggccgaccgactcaagttcctcgcctctcccgctggtaaggacgagtacgcccagtggatcgtcgccaaccagcgatctctgctcgaggtcatgcagtccttcccctctgccaagccccctctgggtgttttcttcgccgccgttgctccccgactccagccccgatactactccatctcttcttctcccaagatgtcccccaaccgaatccacgtcacctgtgctctggtctacgaaaccacccccgccggccgaatccaccgaggcctctgttccacctggatgaagaacgccgtccccctgaccgagtcccccgactgctcccaggcttccatcttcgtccgaacctccaacttccgactccccgttgaccccaaggtccccgtcatcatgatcggtcccggtaccggtctggcccccttccgaggcttcctgcaggagcgactcgctctcaaggagtccggcaccgagctcggttcctccatcttcttctttggctgccgaaaccgaaaggtcgacttcatctacgaggacgagctcaacaactttgtcgagactggtgctctctccgagctcattgttgccttctcccgagagggtaccgccaaggagtacgtccagcacaagatgtcccagaaggcctccgacatctggaagctcctctccgagggtgcctacctctacgtctgcggtgacgccaagggtatggccaaggatgtccaccgaaccctgcacaccattgtccaggagcagggctctctcgactcttccaaggccgagctctacgtcaagaacctccagatgtccggccgatacctccgagatgtgtgg

SEQ ID NO: 151 - DNA, 2397 bp, Lactuca sativa
atgaaaaccatgatctcttctcccatccccgctttccacccccgattctctcctgctgctggctctcgacgactctcccccatcctcccctcttccggctccgtcgttctgaccggctccaagacccagtgcaaggctgtctccaagtcccccacccaggagtacttcgacgttctgcagaagaacggtctgcccttcatcaactggcagaacgacgttgtcgaggacgagctcgacaaggagaagaagattctctaccccaacgacgagatcaagggctttgtcgagcgaatcaaggtcatgctcggctccatggacgagggtgagatcactgtctccgcctacgacaccgcctgggttgctctcgtccaggacattgacggcaacggtcgacccgagttcccctcctctctcgagtggatcgtcaagaaccagctgtccgacggctcttggggtgaccacctcatcttctccgcccacgaccgaatcatcaacaccctcgcctgtgtcattgctctgacctcttggaacgtccaccccggcaagtgccagaagggtctgaagttcctcaacgacaacatctccaagctcgaagaggagaaccccgagcacatgcccattggtttcgaggttgccttcccctctctcattgacattgcccgaaagctcgatatccaggtccccgaggactcccctgctctcaaggagatctacgcccgacgaaacctcaagctcaccaagatccccaagtctctcatgcacaaggtccccaccactctgctgcactctctcgagggtatgcccgatctcgagtgggagaagctgctcaagctccagtgcaaggacggttccttcctcttctccccctcctccaccgccttcgccctcatgcagaccaaggaccagaagtgtctgcagtacctcaccgacgccgtcaccaagttcaacggtggtgtccccaacgtctaccccgtcgacctctttgagcacatctgggttgtcgaccgactgcagcgactcggtatctctcgatactttgactccgagatcaaggactgtgtcgactacatctaccgatactggaccaaggacggtatctgctgggccaagaactccaacgtccaggacattgacgacaccgccatgggcttccgagttctgcgaatgcacggctacaaggtcaccactgacgttttccgacagttcgagaaggacggcaagttcgtctgtttccccggccagaccacccaggccgtcaccggtatgttcaacctcttccgagcttcccaggttctcttccccgacgagaagattctcgaggacgccaagaagttctcctacaactacctcaaggagaagcagtccaccaacgagctcctcgacaagtggatcattgccaaggatctgcccggtgaggtcgagtacgccctcgatgtcccctggtacgcctctctgcctcgactcgagactcgattctacctcgagcagtacggtggcgaggacgatgtctggatcggtaagactctctaccgaatgggtaacgtttccaacaacacctacctcgagatggccaagctcgactacaacaactgtctggccatccaccacctcgagtggaacaccatgcagcagtggtacgtcgactttggtatggagcgattcggtacctccgatatcacctctctgcttgtctcttactacctcgccgctgcctccgtctttgagcccgagcgatccaaggagcgaattgcctgggccaagaccaccactctggtcgacaccatctcctccttcttccactctctcaagatctccaacgagcaccgacgagagtttgtcgaggagttccgaaacatctccaactccatccaccacgccaagtacggcaagccctggcacggtctgatggttgctctcaagggtactctgcacgagattgctctcgatgttctcatgacccaccgacgagacatccacccccagctccaccacgcctgggagatgtggctcatgcgatggcagcagggtgttgacgccaccgagggccaggctgagctcattgtccagaccatcaacatgaccgccggtcgatgggtttccaacgagctgctcgcccacccccagtaccgactcctctcctccgtcatcaacaacatctgccacgagatctaccacaaccgaacctgcatggaggtcaactccaccaccatctccacctccattgactccaagatgcaggagctcgtccagctggttctctccgactctctcgatgatctcgaccaggatctcaagcagaccttcctgaccgttgccaagaccttctactacaaggcctactgcgaccccgagactatcaacgtccacatctccaaggtcatgtttgagactattatt

SEQ ID NO: 152 - DNA, 2271 bp, Lactuca sativa
atgtgcaaggctgtctccaagtcccccacccaggagtacttcgacgttctgcagaagaacggtctgcccttcatcaactggcagaacgacgttgtcgaggacgagctcgacaaggagaagaagattctctaccccaacgacgagatcaagggctttgtcgagcgaatcaaggtcatgctcggctccatggacgagggtgagatcactgtctccgcctacgacaccgcctgggttgctctcgtccaggacattgacggcaacggtcgacccgagttcccctcctctctcgagtggatcgtcaagaaccagctgtccgacggctcttggggtgaccacctcatcttctccgcccacgaccgaatcatcaacaccctcgcctgtgtcattgctctgacctcttggaacgtccaccccggcaagtgccagaagggtctgaagttcctcaacgacaacatctccaagctcgaagaggagaaccccgagcacatgcccattggtttcgaggttgccttcccctctctcattgacattgcccgaaagctcgatatccaggtccccgaggactcccctgctctcaaggagatctacgcccgacgaaacctcaagctcaccaagatccccaagtctctcatgcacaaggtccccaccactctgctgcactctctcgagggtatgcccgatctcgagtgggagaagctgctcaagctccagtgcaaggacggttccttcctcttctccccctcctccaccgccttcgccctcatgcagaccaaggaccagaagtgtctgcagtacctcaccgacgccgtcaccaagttcaacggtggtgtccccaacgtctaccccgtcgacctctttgagcacatctgggttgtcgaccgactgcagcgactcggtatctctcgatactttgactccgagatcaaggactgtgtcgactacatctaccgatactggaccaaggacggtatctgctgggccaagaactccaacgtccaggacattgacgacaccgccatgggcttccgagttctgcgaatgcacggctacaaggtcaccactgacgttttccgacagttcgagaaggacggcaagttcgtctgtttccccggccagaccacccaggccgtcaccggtatgttcaacctcttccgagcttcccaggttctcttccccgacgagaagattctcgaggacgccaagaagttctcctacaactacctcaaggagaagcagtccaccaacgagctcctcgacaagtggatcattgccaaggatctgcccggtgaggtcgagtacgccctcgatgtcccctggtacgcctctctgcctcgactcgagactcgattctacctcgagcagtacggtggcgaggacgatgtctggatcggtaagactctctaccgaatgggtaacgtttccaacaacacctacctcgagatggccaagctcgactacaacaactgtctggccatccaccacctcgagtggaacaccatgcagcagtggtacgtcgactttggtatggagcgattcggtacctccgatatcacctctctgcttgtctcttactacctcgccgctgcctccgtctttgagcccgagcgatccaaggagcgaattgcctgggccaagaccaccactctggtcgacaccatctcctccttcttccactctctcaagatctccaacgagcaccgacgagagtttgtcgaggagttccgaaacatctccaactccatccaccacgccaagtacggcaagccctggcacggtctgatggttgctctcaagggtactctgcacgagattgctctcgatgttctcatgacccaccgacgagacatccacccccagctccaccacgcctgggagatgtggctcatgcgatggcagcagggtgttgacgccaccgagggccaggctgagctcattgtccagaccatcaacatgaccgccggtcgatgggtttccaacgagctgctcgcccacccccagtaccgactcctctcctccgtcatcaacaacatctgccacgagatctaccacaaccgaacctgcatggaggtcaactccaccaccatctccacctccattgactccaagatgcaggagctcgtccagctggttctctccgactctctcgatgatctcgaccaggatctcaagcagaccttcctgaccgttgccaagaccttctactacaaggcctactgcgaccccgagactatcaacgtccacatctccaaggtcatgtttgagactattatt

SEQ ID NO: 153 - DNA, 2283 bp, Picea glauca
atgaagatgtccaagtccgtcgaggtccagcactgcgccgtccagttcctgtcctccaccaccgaccagattgagatccgagagcgaaacctccagatctccaccgaggccatgaagatgaagtcttggatcgagactgtcaagtacattctgcagtccatggaggacggtgagatcaccatctctgcttacgacactgcctggatcgccctcgtccccgctctcaacggctcttccgagccccagttcccctcttctctgcagtggctcatcaacaaccagctccaggacggctcttggggtgaccccctcatgttcctcatccgagatcgaatcatcaacaccctcgcctgtgtccttgctctcaagacctggaacatccactctctcggtgtcaacaagggtctgtccttcctccagacctacatccccaagatgaacgacgagcacgacgcccacacccccgttggctttgagattgtctttcctgctctcatggaggacgccaagatcatggagctcgatctgccctacgacgccgagttcctccagaagatctacgacgagcgagatctcaagatgaagcgaatccccatgaaggttctgcacgagttcccctccactctgctccactctctcgagggcctccgagacaaggtcaactgggaggagctcctcaagctccagtccaagaacggttccttcctcttctcccccgcctccaccgcctgtgctctggcccagacctccgacaccaactgtctgcgatacctcaacgagatcaccaagaagtacgacggtggtgctcccaacgtctaccccgttgacctctttgagcgactctggaccgtcgaccgaattgagcgactcggtattgcccgatactttgagtccgagatcaccgactctctcgagtacgtctaccgatactggaccaaccagggtattggctgggcccgagactcccccgtcaaggacgttgacgacacctccatggccttccgactgctgcgatcccacggcttcgatgtcactgccgaggccttcaaccacttcaagcaggacgaccagttcttctgcttctttggccagaccaagcagaccgtcaccggtatgtacaacctctaccgagcctcccagttctccttccccggtgagtccatcctcgaggaagctcgagtctttaccaagaacttcctcgaggagaagcgagctgagaagcagctgcgagacaagtggatcattgccaagggcctcaaggaagaggtcgagtacgctctcaagttcccctggtacgcctctcagcctcgaattgacacccgaatgtacatcaaccagtaccgagttgatgatgtctggatcggtaaggctctctaccgaatgcccattgtcaacaacaagacctacattgagctcgccaaggctgacttcaacatctgccagtccatccaccgaaccgagctccacggtatcatccgatggtaccgagagtccggtctggacgagctcggtctgcgacaggaccagattgtcaagtcttacttcctcgccgccattgccatctacgagcccgacatggcctccgcccgactcgcctgggccaagtctgctgttctcatggctgccatccgaatcttcttctccggtgagaactgctttgcccaccaccgacgacagttcctcgacgccttcacccgatgggacggccgagccatgcgagactcccccaactccgccaagcgactcttctcttgtctcttccgaatggtcaacctcttctccgtcgacggtgttgttgcccagggccgagacatctccggtgatctgcgacaccgatgggagcactggctcgcctccgaggccgaggatctgaccgacgcccaggaccacgagaagctcggtaccgaggctgagattgttgttctgaccgctgctttcctcggccgagagactatctcccccgatctcatctcccaccccgacttctcctccatcatgaaggtcaccaacaccgtctgctctctgctgcgacgaattgccacctacaaggaagagggctgcgactccccctccggtactgaagaggacgaccgactcaagcgacgagctgaagagggtatgggccaccttgtccgagccgtctaccgacaccagtactcccccgtcccctctggtgtcaagcgactctgtctggttgtcggcaagtctttctactacgccgcccactgcaacaacgaggaagtcggcaaccacgttgagactgttctcttccagcccgtgtat

SEQ ID NO: 154 - DNA, 1548 bp, Bradyrhizobium japonicum
atgaacgccctctccgagcacattctgtccgagctccgacgactcctctccgagatgtccgacggtggttccgtcggcccctccgtctacgacaccgcccaggctctgcgattccacggtaacgtcaccggccgacaggacgcctacgcctggctcattgcccagcagcaggctgacggtggctggggttccgccgacttccctctcttccgacacgcccccacctgggctgctctgctcgctctgcagcgagccgaccccctccccggtgctgccgacgccgtccagaccgccacccgattcctccagcgacagcccgacccctacgcccacgccgtccccgaggacgcccccattggtgccgagctcatcctcccccagttctgcggtgaggctgcttctctgctcggtggtgttgccttcccccgacaccccgctctgctccccctccgacaggcctgtctggtcaagctcggtgccgtcgccatgctcccctccggccaccctctgctccactcttgggaggcctggggtacttctcccaccactgcctgccccgacgacgacggctccatcggtatctctcccgctgccaccgccgcctggcgagcccaggctgtcacccgaggctccactccccaggtcggccgagccgatgcctacctccagatggcctctcgagccacccgatccggtatcgagggtgttttccccaacgtctggcccatcaacgtctttgagccctgctggtccctctacaccctccacctcgccggcctcttcgcccaccccgctctcgccgaggctgtccgagtcatcgtcgcccagctcgacgcccgactcggtgtccacggtcttggccccgctctgcactttgctgccgacgccgacgacaccgccgttgctctctgtgttctgcacctcgccggccgagatcccgccgtcgatgctctgcgacactttgagattggtgagctcttcgtcaccttccccggtgagcgaaacgcctccgtttccaccaacatccacgccctccacgccctccgactcctcggcaagcccgctgccggtgcctccgcctacgtcgaggccaaccgaaacccccacggtctgtgggacaacgagaagtggcacgtcagctggctctaccccaccgcccacgccgttgctgctctcgcccagggcaagccccagtggcgagatgagcgagctctggctgctctgctccaggcccagcgagatgacggtggctggggtgctggccgaggctccaccttcgaggagactgcctacgccctcttcgccctccacgtcatggacggctctgaagaggccaccggccgacgacgaatcgcccaggttgttgcccgagctctcgagtggatgctcgcccgacacgccgcccacggtctgccccagacccctctgtggatcggtaaggagctctactgccccacccgagttgtccgagttgccgagctcgccggtctgtggctcgctctgcgatggggccgacgagtcctcgccgagggtgccggtgctgcccca

SEQ ID NO: 155 - DNA, 2364 bp, Lactuca sativa
atgaacattgcccagatcacctcttctgccatgctcgtcccctcttcccacattccccaccgatcttgggtcgtcaactgctgcatggtccagtacaacccctccggtctgcgaaccgcttcttcccaggctggccaggtcaaccccactgtcatgaccctcgatgtcaccaaggagcgaatccgaaagctcttcaacaacgttgaggtttccgtttcctcttacgacaccgcctgggttgccatggtcccctctcccaactcccccaagtctccttgtttccccgactgtctcaactggctcctcgacaaccagctcgacgacggctcttggggtctgctcccccaccagtctcctctgatcaaggacaccctctcttccactctggcctgtgtccttgctctcaagcgatggaacgtcggtaaggaccagatcaacaagggtctgcactacattgagtccaactttgcctccgtcaccgacaagaaccaggcttctccctttggcttcgacatcatcttccccggtatgctcgagtacgccaaggacctcgatatcaagctgcccctcaaccagacccacctgtccgtcatgctccacgagcgagagctcgagctccgacgatgccactccaacggccgagaggcctacctcgcctacatctccgagggtcttggtaacctcaacgactggaacatggtcatgaagtaccagatgaagaacggctctctgttcaactccccctctgccaccgcctccgttctcatccaccaccagaacgccggctgtctgcactacctgacctctctgctcgacaagtttggtaacgctgtccccaccgtctaccccattgatctgtacgtccgactctccatggtcgacaccctcgagcgactcggtatcaagcgacacttcatggtcgagatccagaacgttctcgacgagacttaccgatgctgggtccagggtgatgtccagatcttcatggacgttgtcacctgtgctctggccttccgagttctgcgatccaacggttacgaggtttcttccgaccctctggccaagatcaccaaggaaggtgactacatgaactcccccgagaagcccttcaaggacgtctacacctctctcgaggtctacaaggcctcccagatcatctaccaagaggagctcgccttccgagagcagaacctgacctcctacctgccctcttccaacaagctctccaactacattctcaaagaggtcgacgacgctctcaagttccccttcaacggctctctcgagcgaatgtccacccgacgaaacattgagcactacaacctcaaccacacccgaattctcaagaccacctactcctcttccaacatctccaacaaggactacctcaagctcgccgtccaggacttcaacgagtgccagtccatctactgtgaggagctcaaggacctcgagcgatgggttgtcgagaaccgactcgacaagctcaagtttgcccgacaaaagactgcttactgctacttctccgctgcctctttcctctcctcccccgatctgtccgacgcccgaatctcttgggccaagtcctccattctgaccaccgtcattgacgacttcttcgatgtcggtggctccatggacgagctcgtcaactttgtccacatcattgagaagtggaacgtcaacgtcgagaacgactgctgctccgaagaggtcggtgttctcttcctggctctcaaggacgccgtctgctggatcggtgacaaggccttcaagatccaggagcgaaacatcacctcccacgtcattgagatctggctcgatctcgtcaagtccatgctgcgagaggccatctgggccaaggacggctccatccccaccatcaacgagtacatggagaacggctacgtttcctttgctctcggtcccattgttctgcccactctctacttcctcggtgtcaagctgtccgaggaagttgtccagtcctccgagtaccacaagctctacgaggtcatgtccacccagggccgactcatgaacgacatccactccttcaagcgagagaagaaggctggtaagctcaacgccgtcgccctctacatgtccgacggcaagtccggctccgtcgaagaggaagttgtcgaggagatgaagatcctcaccaagtcccagcgaaaggagatgatgaagctcgttctcgagactaagggctccgtcgtcccccgagtctgcaaggatgttttctggaacatgtgcaacgttctcaacctcttctacgccaccgacgacggtttcactggtaacgccattctcgatgttgtcaaggagatcatctacgagcccgtttcccacgagctcatc

SEQ ID NO: 156 - DNA, 2250 bp, Lactuca sativa
atggcttcttcccaggctggccaggtcaaccccactgtcatgaccctcgatgtcaccaaggagcgaatccgaaagctcttcaacaacgttgaggtttccgtttcctcttacgacaccgcctgggttgccatggtcccctctcccaactcccccaagtctccttgtttccccgactgtctcaactggctcctcgacaaccagctcgacgacggctcttggggtctgctcccccaccagtctcctctgatcaaggacaccctctcttccactctggcctgtgtccttgctctcaagcgatggaacgtcggtaaggaccagatcaacaagggtctgcactacattgagtccaactttgcctccgtcaccgacaagaaccaggcttctccctttggcttcgacatcatcttccccggtatgctcgagtacgccaaggacctcgatatcaagctgcccctcaaccagacccacctgtccgtcatgctccacgagcgagagctcgagctccgacgatgccactccaacggccgagaggcctacctcgcctacatctccgagggtcttggtaacctcaacgactggaacatggtcatgaagtaccagatgaagaacggctctctgttcaactccccctctgccaccgcctccgttctcatccaccaccagaacgccggctgtctgcactacctgacctctctgctcgacaagtttggtaacgctgtccccaccgtctaccccattgatctgtacgtccgactctccatggtcgacaccctcgagcgactcggtatcaagcgacacttcatggtcgagatccagaacgttctcgacgagacttaccgatgctgggtccagggtgatgtccagatcttcatggacgttgtcacctgtgctctggccttccgagttctgcgatccaacggttacgaggtttcttccgaccctctggccaagatcaccaaggaaggtgactacatgaactcccccgagaagcccttcaaggacgtctacacctctctcgaggtctacaaggcctcccagatcatctaccaagaggagctcgccttccgagagcagaacctgacctcctacctgccctcttccaacaagctctccaactacattctcaaagaggtcgacgacgctctcaagttccccttcaacggctctctcgagcgaatgtccacccgacgaaacattgagcactacaacctcaaccacacccgaattctcaagaccacctactcctcttccaacatctccaacaaggactacctcaagctcgccgtccaggacttcaacgagtgccagtccatctactgtgaggagctcaaggacctcgagcgatgggttgtcgagaaccgactcgacaagctcaagtttgcccgacaaaagactgcttactgctacttctccgctgcctctttcctctcctcccccgatctgtccgacgcccgaatctcttgggccaagtcctccattctgaccaccgtcattgacgacttcttcgatgtcggtggctccatggacgagctcgtcaactttgtccacatcattgagaagtggaacgtcaacgtcgagaacgactgctgctccgaagaggtcggtgttctcttcctggctctcaaggacgccgtctgctggatcggtgacaaggccttcaagatccaggagcgaaacatcacctcccacgtcattgagatctggctcgatctcgtcaagtccatgctgcgagaggccatctgggccaaggacggctccatccccaccatcaacgagtacatggagaacggctacgtttcctttgctctcggtcccattgttctgcccactctctacttcctcggtgtcaagctgtccgaggaagttgtccagtcctccgagtaccacaagctctacgaggtcatgtccacccagggccgactcatgaacgacatccactccttcaagcgagagaagaaggctggtaagctcaacgccgtcgccctctacatgtccgacggcaagtccggctccgtcgaagaggaagttgtcgaggagatgaagatcctcaccaagtcccagcgaaaggagatgatgaagctcgttctcgagactaagggctccgtcgtcccccgagtctgcaaggatgttttctggaacatgtgcaacgttctcaacctcttctacgccaccgacgacggtttcactggtaacgccattctcgatgttgtcaaggagatcatctacgagcccgtttcccacgagctcatc

SEQ ID NO: 157 - DNA, 2271 bp, Picea glauca
atgaagcgagagcagtacaccatcctcaacgagaaggagtccatggccgaggagctcatcctccgaatcaagcgaatgttctccgagattgagaacacccagacctccgcctccgcctacgacaccgcctgggttgccatggtcccctctctcgactcctcccagcagccccagttcccccagtgcctctcttggatcatcgacaaccagctcctcgacggctcttggggtatcccctacctcatcatcaaggaccgactctgccacaccctcgcctgtgtcattgctctgcgaaagtggaacgccggtaaccagaacgtcgagactggtctgcgattcctgcgagagaacattgagggtattgtccacgaggacgagtacacccccattggtttccagatcatcttccccgccatgctcgaggaagctcgaggtctgggtctggagctcccctacgatctgacccccatcaagctcatgctgacccaccgagagaagatcatgaagggcaaggccattgaccacatgcacgagtacgactcctctctcatctacaccgtcgagggtatccacaagattgtcgactggaacaaggttctcaagcaccagaacaaggacggctctctcttcaactccccctctgccaccgcctgtgctctcatgcacacccgaaagtccaactgtctggagtacctctcttccatgctccagaagctcggtaacggtgtcccctccgtctaccccatcaacctctacgcccgaatctccatgattgaccgactccagcgactcggtctggcccgacacttccgaaacgagatcatccacgccctcgacgacatctaccgatactggatgcagaaggagacttctcgagagggcaagtctctcacccccgacattgtttccacctccattgccttcatgctgctgcgactccacggctacgatgtccccgctgacgttttctgctgctaccacctccactccattgagcagtccggtgaggctgtcactgccatgctgtctctgtaccgagcctcccagatcatgttccccggtgagactatcctcgaggagatcaagaccgtttcccgaaagtacctcgacaagcgaaaggagaacggtcgaatctactaccacaacattgtcatgaaggacctccgaggtgaggttgagtacgccctctccgtcccctggtacgcctctctcgagcgaatcgagaaccgacgatacattgaccagtacggtgtcaacgacacctggatcgccaagacctcttacaagatcccctgtatctccaacgatctgttcctggctctggccaagcaggactacaacatctgtcaggccatccagcagaaggagctccgagagctcgagcgatggttcgccgacaacaagttctcccacctcaactttgcccgacagaagctcatctactgctacttctccgctgctgccactctcttctctcccgagctctctgctgctcgagttgtctgggccaagaacggtgtcatcaccaccgttgttgacgacttcttcgatgttggtggctcctccgaggagatccactcttttgtcgaggctgtccgagtctgggatgaggctgccaccgacggtctgtccgagaacgtccagatcctcttctccgctctgtacaacaccgttgacgagattgtccagcaggcctttgtctttcagggccgagacatctccatccacctgcgagagatctggtaccgactcgtcaactccatgatgaccgaggcccagtgggcccgaacccactgcatcccctccatgcacgagtacatggagaacgccgagccttccattgctctcgagcccattgttctctcctctctctactttgtcggccccaagctgtccgaggagatcatctgccaccccgagtactacaacctcatgcacctgctcaacatctgtggccgactcctcaacgatatccagggctgcaagcgagaggcccaccagggcaagctcaactccgtcactctctacatggaggagaactccggcaccaccatggaggatgccattgtctacctgcgaaagaccatcgacgagtcccgacagctcctcctcaaagaggttctgcgaccttccattgtcccccgagagtgcaagcagctccactggaacatgatgcgaatcctccagctcttctacctcaagaacgacggtttcacctcccccaccgagatgctcggctacgtcaacgccgtcattgtcgaccccatattg

SEQ ID NO: 158 - DNA, 900 bp, Bradyrhizobium japonicum
atgatccagaccgagcgagccgtccagcaggttctcgagtggggtcgatctctgaccggctttgccgacgagcacgccgtcgaggccgtccgaggtggtcagtacatcctccagcgaatccacccctctctgcgaggtacctccgcccgaaccggccgagatccccaggacgagactctcattgtcaccttctaccgagagctcgctctgctcttctggctcgacgactgcaacgatctcggcctcatctcccccgagcagctcgccgccgtcgagcaggctctcggccagggtgtcccctgtgctctgcccggtttcgagggctgtgccgtcctccgagcttctctcgccaccctcgcctacgaccgacgagactacgcccagctcctcgacgacacccgatgctactccgctgctctgcgagctggtcacgcccaggctgttgctgccgagcgatggtcctacgccgagtacctccacaacggtatcgactccattgcctacgccaacgttttctgctgtctgtctctgctctggggcctcgacatggccactctgcgagcccgacccgccttccgacaggttctgcgactcatctccgccatcggtcgactccagaacgatctccacggctgcgacaaggaccgatccgccggtgaggctgacaacgccgtcattctgctcctccagcgataccccgccatgcccgttgtcgagttcctcaacgacgagctcgccggccacacccgaatgctgcaccgagtcatggccgaggagcgattccccgctccctggggtcctctcattgaggccatggctgccatccgagtccagtactaccgaacctccacctcccgataccgatccgatgccgtccgaggtggtcagcgagctcccgcc

SEQ ID NO: 159 - DNA, 2838 bp, Phaeosphaeria sp
atgttcgccaagttcgacatgctcgaggaagaggcccgagctctggtccgaaaggtcggtaacgccgtcgaccccatctacggtttctccaccacctcctgccagatctacgacaccgcctgggccgccatgatctccaaagaggagcacggtgacaaggtctggctcttccccgagtccttcaagtacctcctcgagaagcagggtgaggacggctcttgggagcgacacccccgatccaagaccgtcggtgttctcaacaccgccgccgcctgtctggctctcctccgacacgtcaagaaccccctgcagctgcaggacattgctgcccaggacatcgagctccgaatccagcgaggtctgcgatctctcgaggagcagctcatcgcctgggatgacgttctggacaccaaccacattggtgtcgagatgattgtccccgctctgctcgactacctccaggccgaggacgagaacgtcgacttcgagtttgagtcccactctctgctcatgcagatgtacaaggagaagatggcccgattctcccccgagtctctctaccgagctcgaccctcttctgctctgcacaacctcgaggctctcatcggtaagctcgatttcgacaaggtcggccaccacctctacaacggctccatgatggcctccccctcttccactgccgccttcctcatgcacgcctctccctggtcccacgaggccgaggcctacctccgacacgtctttgaggctggtaccggcaagggctccggtggtttccccggtacctaccccaccacctactttgagctcaactgggtcctctccaccctcatgaagtccggcttcactctctccgatctcgagtgcgacgagctctcctccattgccaacaccatcgccgagggtttcgagtgcgaccacggtgtcatcggtttcgctccccgagccgtcgacgttgatgacactgccaagggtctgctcaccctcaccctcctcggtatggacgagggtgtctcccccgctcccatgattgccatgttcgaggccaaggaccacttcctgaccttcctcggtgagcgagatccctccttcacctccaactgccacgttctgctctctctgctccaccgaaccgacctcctccagtacctcccccagatccgaaagaccaccaccttcctctgtgaggcctggtgggcctgcgacggccagatcaaggacaagtggcacctctcccacctctaccccaccatgctcatggtccaggcctttgccgagatcctcctcaagtccgccgagggtgagcctctgcacgacgcctttgacgccgccactctgtctcgagtctccatctgtgttttccaggcctgtctgcgaactctgctcgcccagtcccaggacggctcttggcacggccagcccgaggcttcttgctacgccgtcctcaccctcgccgagtccggccgacttgttctgctccaggctctgcagccccagattgctgctgccatggagaaggctgctgatgtcatgcaggctggtcgatggtcttgttccgaccacgactgtgactggacctccaagaccgcctaccgagtcgacctcgttgctgctgcttaccgactcgccgccatgaaggcctcttccaacctcaccttcaccgtcgacgacaacgtttccaagcgatccaacggtttccagcagctcgtcggccgaaccgacctcttctccggtgtccccgcctgggagctccaggcctctttcctcgagtccgctctgtttgtccctctgctccgaaaccaccgactcgatgtctttgaccgagatgatatcaaggtttccaaggaccactacctcgatatgatccccttcacctgggtcggctgcaacaaccgatctcgaacctacgtttccacctccttcctcttcgacatgatgatcatctccatgctcggctaccagattgacgagttcttcgaggctgaggctgcccccgccttcgcccagtgcatcggtcagctccaccaggttgttgacaaggtcgtcgacgaggtcattgacgaggttgtcgacaaggttgtcggtaaggtcgtcggtaaggtcgtcggcaaggtcgtcgacgagcgagtcgactcccccacccacgaggccatcgccatctgcaacatcgaggcttctctgcgacgattcgtcgaccacgttctccaccaccagcacgttctgcacgcctcccagcaggagcaggatatcctctggcgagagctccgagccttcctgcacgcccacgttgtccagatggccgacaactccactctcgctcctcccggccgaaccttctttgactgggtccgaaccactgctgccgaccacgttgcctgtgcctactccttcgccttcgcctgctgcatcacctccgccaccattggccagggccagtccatgtttgccaccgtcaacgagctctacctggtccaggctgctgcccgacacatgaccaccatgtgccgaatgtgcaacgacattggctccgtcgaccgagacttcattgaggccaacatcaactccgtccacttccccgagttctccactctgtctctcgttgctgacaagaagaaggctctggcccgactcgccgcctacgagaagtcttgtctgacccacaccctcgaccagtttgagaacgaggttctccagtctccccgagtctcctccgccgcctccggtgacttccgaacccgaaaggtcgccgttgtccgattcttcgccgatgtcactgacttctacgaccagctctacatcctccgagatctgtcctcctctctcaagcacgtcgggaca

SEQ ID NO: 160 - DNA, 2856 bp, Gibberella fujikuroi
atgcccggcaagattgagaacggtacccccaaggacctcaagaccggcaacgacttcgtttccgctgccaagtctctgctcgaccgagccttcaagtcccaccactcctactacggtctgtgctccacttcctgccaggtctacgacaccgcctgggttgccatgatccccaagacccgagacaacgtcaagcagtggctcttccccgagtgtttccactacctgctcaagacccaggctgctgacggctcttggggctctctgcccaccacccagaccgccggtatcctcgacactgcctccgccgttctggctctgctctgccacgcccaggagcctctgcagatcctcgatgtctcccccgatgagatgggtctgcgaatcgagcacggtgtcacttctctcaagcgacagctcgccgtctggaacgacgttgaggacaccaaccacattggtgtcgagttcatcatccccgctctgctctccatgctcgagaaggagctcgatgtcccctccttcgagttcccttgccgatccattctggagcgaatgcacggcgagaagctcggtcactttgatctcgagcaggtctacggcaagccctcttctctgctgcactctctcgaggccttcctcggcaagctcgatttcgaccgactctcccaccacctctaccacggctccatgatggcctccccctcttccaccgccgcctacctcattggtgccaccaagtgggacgacgaggccgaggactacctccgacacgtcatgcgaaacggtgccggccacggtaacggtggtatctctggtaccttccccaccacccactttgagtgctcctggatcattgccactctcctcaaggtcggtttcactctcaagcagattgacggtgacggtctgcgaggcctctccaccattctcctcgaggctctgcgtgacgagaacggtgtcattggcttcgctccccgaaccgccgacgttgatgacactgccaaggctctgctggctctgtctctggtcaaccagcccgtttcccccgacatcatgatcaaggttttcgagggtaaggaccacttcaccacctttggctccgagcgagatccctctctgacctccaacctccacgttctcctctctctgctcaagcagtccaacctgtctcagtaccacccccagatcctcaagaccactctcttcacctgtcgatggtggtggggctccgaccactgtgtcaaggacaagtggaacctctcccacctctaccccaccatgctcctcgtcgaggccttcaccgaggttctgcacctcatcgacggtggtgagctctcctctctgtttgacgagtctttcaagtgcaagatcggtctgtccatcttccaggccgttctccgaatcatcctcacccaggacaacgacggctcttggcgaggctaccgagagcagacctgttacgccattctcgccctcgtccaggcccgacacgtctgtttcttcacccacatggtcgaccgactccagtcctgtgtcgaccgaggtttctcttggctcaagtcttgctccttccactctcaggacctcacctggacctccaagaccgcttacgaggttggtttcgttgccgaggcctacaagctcgctgctctccagtccgcctctctcgaggtccccgctgccaccatcggccactccgtcacctctgctgtcccctcctccgatctcgagaagtacatgcgactcgtccgaaagaccgctctgttctctcccctcgatgagtggggtctgatggcctccatcatcgagtcctccttctttgtccccctcctccaggcccagcgagttgagatctacccccgagacaacatcaaggtcgacgaggacaagtacctctccatcatccccttcacctgggttggctgcaacaaccgatctcgaacctttgcctccaaccgatggctctacgacatgatgtacctgtctctgctcggctaccagaccgacgagtacatggaggccgttgccggccccgtctttggtgatgtctctctgctgcaccagaccatcgacaaggtcattgacaacaccatgggtaacctggcccgagccaacggtaccgtccactccggcaacggtcaccagcacgagtcccccaacattggccaggtcgaggacaccctcactcgatttaccaactccgtcctcaaccacaaggacgtcctcaactcctcctcctccgaccaggacaccctccgacgagagttccgaaccttcatgcacgcccacatcacccagatcgaggacaactcccgattctccaagcaggcttcttccgacgccttctcctcccccgagcagtcctacttccagtgggtcaactccactggtggttcccacgttgcctgcgcctactctttcgccttctccaactgcctcatgtccgccaacctcctccagggtaaggacgccttcccttccggtacccagaagtacctcatctcctccgtcatgcgacacgccaccaacatgtgccgaatgtacaacgatttcggttccatcgcccgagacaacgccgagcgaaacgtcaactccatccactttcccgagttcactctctgtaacggtacctcccagaacctcgacgagcgaaaggagcgactcctcaagattgctacttacgagcagggctacctcgaccgagctctcgaggctctggagcgacagtcccgagatgatgctggtgaccgagccggctccaaggacatgcgaaagctcaagattgtcaagctcttctgtgacgtcaccgacctctacgaccagctctacgtcatcaaggacctctcctcctccatgaaa

SEQ ID NO: 161 - DNA, 1533 bp, Lactuca sativa
atggatctgcagaccatggcccccatgggctctgctgccattgccatcggtggtcccgctgttgccgttgctggtggtatctctctgctcttcctcaagtctttcctgtcccagcagcccggcaaccccaaccacctcccctccgtccccgctgtccccggtgtccctctgctcggtaacctgctcgagctcaaggagaagaagccctacaagaccttcaccaagtgggccgagacttacggccccatctactccatcaagactggtgccacctccatggtcgttgtcaactccaaccagctcgccaaagaggccatggtcacccgattcgactccatctccacccgaaagctctccaaggctctccagattctcactgctgacaagaccatggttgccatgtccgactacgacgactaccacaagaccgtcaagcgaaacctgctcacctccatcctcggtcccgctgcccagaagcgacaccgagcccaccgagatgccatgggtgacaacctgtctcgacagctccacgctcttgctctcaactctcctcaagaggccatcaacttccgacagatcttccagtccgagctcttcactctcgccttcaagcagacctttggccgagacattgagtccatcttcgtcggtgatctcggtaccaccatgacccgagaggagatgttccagatcctcgttgtcgaccccatgatgggtgccattgacgttgactggcgagacttcttcccctacctcaagtggatccccaacgccaagctcgaggagaagattgagcagatgtacatccgacgaaaggccgtcatgaaggccgtcatccaggagcaccgaaagcgaattgactccggcgagaacctcgactcttacattgacttcctgctcgccgaggcccagcctctgaccgagaagcagctcctcatgtctctgtgggagcccatcattgagacttccgacaccaccatggtcaccaccgagtgggccatgtacgagctctccaagcaccccaacaagcagcagcgactctacaacgagatccgaaacatctgtggttccgagaagatcaccgaggagaagctctgcaagatgccctacctgtctgctgttttccacgagactctgcgagtccactcccccgtttccatcatccccctgcgatacgtccacgagaacaccgagctcggcggctaccacgtccccgccggcaccgagctcgccgtcaacatctacggctgcaacatggagcgagagatctgggagaaccccgaggagtggtcccccgagcgattcctcgccgagaacgagcccgtcaacctgcagaaaaccatggcctttggtgctggtaagcgagtctgcgctggtgccatgcaggccatgctgctcgcctgtgtcggtattggccgaatggtccaggagtttgagtggcgactcaaggacgacgttgaagaggatgtcaacaccctcggcctcaccacccagcgactcaaccccatgctcgccgtcatcaagccccggaat

SEQ ID NO: 162 - DNA, 1536 bp, Lactuca sativa
atggacggtgtcattgacatgcagaccatccccctgcgaactgccattgccattggtggtactgctgttgctctcgttgttgctctctacttctggttcctgcgatcttacgcctccccctctcaccactccaaccaccttcctcccgtccccgaggtccccggtgtccccgtcctcggtaacctgctccagctcaaggagaagaagccctacatgaccttcaccaagtgggccgagatgtacggccccatctactccatccgaaccggtgccacctccatggttgttgtctcttccaacgagattgccaaggaagttgttgtcacccgattcccctccatctccacccgaaagctctcttacgctctcaaggtcctcactgaggacaagtccatggttgccatgtccgactaccacgactaccacaagaccgtcaagcgacacattctcaccgccgtcctcggccccaacgcccagaagaagttccgagcccaccgagacaccatgatggagaacgtttccaacgagctccacgccttcttcgagaagaaccccaaccaggaagtcaacctgcgaaagatcttccagtctcagctctttggtctggccatgaagcaggctctcggcaaggatgtcgagtccatctacgtcaaggatctcgagactaccatgaagcgagaggagatcttcgaggttctggtcgtcgaccccatgatgggtgccattgaggtcgactggcgagacttcttcccctacctcaagtgggtccccaacaagtctttcgagaacatcatccaccgaatgtacacccgacgagaggctgtcatgaaggctctcatccaggagcacaagaagcgaattgcctccggtgagaacctcaactcctacattgactacctgctctccgaggcccagaccctcaccgacaagcagctcctcatgtctctgtgggagcccatcatcgagtcctccgacaccaccatggtcaccaccgagtgggccatgtacgagctcgccaagaaccccaacatgcaggaccgactctacgaggagatccagtctgtctgtggctccgagaagatcactgaggagaacctgtcccagctcccctacctctacgccgttttccaggagactctgcgaaagcactgccccgtccccatcatgcccctgcgatacgtccacgagaacaccgtcctcggtggctaccacgtccccgctggtaccgaggttgccatcaacatctacggctgcaacatggacaagaaggtctgggagaaccccgaggagtggaaccccgagcgattcctgtccgagaaggagtccatggacctctacaagaccatggcctttggtggtggcaagcgagtctgtgccggctctctgcaggccatggtcatctcctgcattggtatcggtcgactcgtccaggactttgagtggaagctcaaggacgatgctgaggaagatgtcaacaccctcggcctcaccacccagaagctccaccctctgctcgccctcatcaacccccggaaa

SEQ ID NO: 163 - DNA, 1575 bp, Sphaceloma manihoticola
atgatggacgacaccacctccccctactccacctaccactccgtccgatccatccgaaaccagtccgcctgggctctggcccccattgccgtctttatctgctacgttgttctgcgacacaaccgaaagtccgtccccgctgcctctgctggttcccactccatcctcgagcccctgtggctcgcccgactccgattcatccgagactctcgattcatcatcggtcagggctactccaagttcaaggacaccatcttcaaggtcaccaaggtcggtgccgatatcattgttgttgctcccaagtacgtcgaggagatccgacgactctcccgagacaccggccgatccgtcgagcccttcatccacgactttgccggtgagctcctcggtggcctcaacttcctcgagtccgatctccagacccgagttgtccagcagaagctcacccccaacctcaagaccattgtccccgtcatggaggacgagatgcactacgctctcgtttccgagctcgactcttgtctcgatggttccgagcactggacccgagtcgacatgatccacatgctctcccgaattgtctctcgaatctccgcccgaatcttcctcggccccaagtactgccgaaacgatctgtggctcaagaccactgccgagtacaccgagaacctcttcctgaccggtactctgctccgattcgtcccccgaatgctccagaagtggatcgctcctctgctcccctctttccgacagctccaggagaaccgacaggccgcccgaaagatcatctccgagattctgaccgaccaccagcccgagaagcacgacgagacttccgacaacggtgacccctaccccgacattctcaccctcatgttccaggctgcccgaggtaaggagaaggacattgaggacattgcccagcacactctgctcctctctctgtcctccatccacaccactgctctgaccatgacccaggctctctacgatctctgtgcctacccccagtacctcgaccccgtcaagcacgagattgccgacactctgcagtccgagggctcttggtccaaggccatgctcgacaagctccacatgatggactctctgctccgagagtcccagcgactctctcccgtctttctgctcaccttcaaccgaatcctccacacccctctgaccctctccaacggtatccacctccccaagggtacccgaattgccgccccctccgacgccatcctcaacgacccctctctggtccccggcccccagcccgctgacaccttcgaccccttccgatacatcaaccactccaccggtgatgccaagaaaaccaagaccaacttccagaccacctctctgcagaacatggcctttggctacggtaagtacgcctgccccggccgattctacgttgccaacgagatcaagctcgttctcggccacctgctcatgcactacgagttcaagttccctcccggtatgggccgacccgtcaactccactgtcgacaccgacatgtaccccgatctcggtgcccgactcctcgtccgaaagcgaaagatggaggag

SEQ ID NO: 164 - DNA, 1440 bp, Artemisia annua
atgcccatgaccgtcatgctgctctttgttttcctgctcttcattgccatctgtttcttcctcgtccaccgacacaactccaccaccaccaagaacctgcctcccggctccttcggctggcccttcattggtgagactctcgcctacatccgatccaagcgaggtggtgaccccgagcgattcaccaaggagcgaatcgagaagtacggctccactctggtctttaagacctccgttgccggtgagcgaatggccgttttctgcggtcccgagggtaacaagttcctctttggcaacgagaacaagctcgttgcttcttggtggcccaactccgtccgaattctcttcgagaagtgtctgatcaccatccgaggtgacgaggccaagtggctccgaaagatgatgttcgcctacctcggtcccgatgctctgtccaaccgatacaccggtaccatggaggttgtcacccgactccacatccagaaccactggcagggcaagtccgagctcaaggtctttgagactgtccgaccttacctcttcgagctcgcctgccgactcttcctgtctctcgacgaccccaagcacgttgccgagctcggtaccctcttcaacaccttcctcaagggtctgaccgagctccccatcaacatccccggtacccgattctaccgagccaagcgagctgccaacgccatcaagaagcagctcattgtcatcatcaagcagcgacgacaggctctcaagcaagaggaccagtcctcctccttcgaggacctcctctcccacctccttgtctcctccgacgagaacggccgattcctgtccgaggctgagattgccaacaacgttctgctcctcctcttcgccggccacgacacttctgctgtctccatcactctgctcatgaagtctctggccgagcacccccaggtctacgacaacgtcctcaaggagcagctcggtattctcgaggccaaggctcccggtgagatgctcaactgggaggatatccagaagatgcgatactcttggtacgttgtctgcgaggtcatgcgactcattcctcccgttgtcggctctttccgagaggctctggtcgactttgagtacgccggctacaccatccccaagggctggaagatcatctggtccgccgtcatgacccacaaagaggagaacaacttccccaacgccaccaagttcgacccctctcgattcgagggtgctggtcccacccccttcacctacgtccccttcggtggtggcccccgaatgtgcctcggcaaggagctcgcccgagtccgaatcctcgtctttctgcacaacatcatgaccaagttcaagtgggatctgctcatccccgacgagaagattggctacgaccccctcgccacccccgtcaagggtctgcccgtccgactccacccccaccaggtt

SEQ ID NO: 165 - DNA, 1365 bp, Ricinus communis
atggagctcgtcatgttccccgttctggctctcgtttccactctcttcctgctcgccctccacttcatcatccgaaccctcaaggagcgactctttggctctcccaacctgcctcccggccgactcggctggcccctcattggtgagactcccgccttcttccgagctggctttgaggccaagcccgagaagttcatcggtgagcgaatggagaagtacgactcccgagtctttaagacctctctgctcggcaagcccttcgccgtcatctccggtaccgccggccacaagttcctcttctccaacgagaacaagctcgtcaacctgtggtggcccgagtccgtccgaatgctcttcaagtctgctctcgtttccgttgtcggtgacgaggccaagcgaatccgaaagatgctcatgaccttcctcggcctcgatgctctcaagaactacaccgagcgaattgacatggtcacccagcagcacatccgaacctactgggagggtaaagaggaagtcaccgtctactccactctcaagctctacaccttcactctggcctgcaacctcttcgcctccatcaacgaccccgagcgactctccaagctcggtgcccacttcgacgtctttgtcaagggtgtcatctctctgcccatctccatccccggtacccgactctacaagtccatgaaggctgccaacgccatccgagaggagctcaagctcattgtccgagatcgaaaagaggctctcgagcgaaagatggcctcccccacccaggatctgctctcctacctgctcgtcgactccgacaccaacggccgattcctgtccgagatggagattctcgacaacatcatgctgctcctctacgctgagcagctcgagattgccaactccaagaagcccggtgagctgctccagtgggaggacgtccagaagatgcgatactcttggaacgtcatctccgaggttctgcgactgtctcctcccgtttcttctgcctaccgacacgccattgttgacttcacctacgagggttacaccatccccaagggctggcagctcttcacctccttcggtaccacccaccgagatcccgctctcttccccaaccccgagcgattcgacgcctctcgattcgagggtaacggtcctccctcctactcctacatccccttcggtggtggtccccgaatgtgcattggctacgagtttgcccgactcgagatgctcatcttcctgcacaacatcatcaagcgattcaagtgggacattctcatccccgacgagcagtttggctacaaccccctgctcgccccctcccagggtttccccgtccgactgcgaccccaccactcccatctc

SEQ ID NO: 166 - DNA, 1428 bp, Stevia rebaudiana
atgatccaggttctgacccccatcctcctcttcctcatcttcttcgttttctggaaggtctacaagcaccaaaagaccaagatcaacctgccccctggctccttcggctggcccttcctcggtgagactcttgctctgctccgagccggctgggactccgagcccgagcgattcgtccgagagcgaatcaagaagcacggctctcctctcgttttcaagacctctctcttcggtgaccgattcgccgttctctgtggtcccgctggtaacaagttcctcttctgcaacgagaacaagctcgttgcctcttggtggcccgtccccgtccgaaagctcttcggcaagtctctgctcaccatccgaggtgacgaggccaagtggatgcgaaagatgctgctctcctacctcggtcccgatgcctttgccacccactacgctgtcaccatggacgttgtcacccgacgacacattgacgtccactggcgaggcaaggaagaggtcaacgttttccagaccgtcaagctctacgcctttgagctcgcctgccgactcttcatgaacctcgacgaccccaaccacattgccaagctcggctctctcttcaacatcttcctcaagggtatcatcgagctccccattgacgttcccggtacccgattctactcctccaagaaggctgctgctgccatccgaatcgagctcaagaagctcatcaaggcccgaaagctcgagctcaaggaaggcaaggcctcctcctcccaggatctgctgtcccacctgctcacctcccccgacgagaacggtatgttcctgaccgaggaagagattgtcgacaacattctgctcctcctctttgccggccacgacacctctgctctgtccatcactctgctcatgaaaactctcggtgagcactccgatgtctacgacaaggtcctcaaggagcagctcgagatctccaagactaaagaggcctgggagtctctcaagtgggaggacatccagaagatgaagtactcctggtccgtcatctgcgaggtcatgcgactcaaccctcccgtcatcggtacctaccgagaggctctggtcgacattgactacgccggctacaccatccccaagggctggaagctccactggtccgctgtctccacccagcgagatgaggccaactttgaggacgtcacccgattcgacccctctcgattcgagggtgccggtcccactcccttcacctttgtccccttcggtggtggtccccgaatgtgtctcggcaaggagtttgcccgactcgaggttctggccttcctgcacaacattgtcaccaacttcaagtgggatctgctcatccccgacgagaagattgagtacgaccccatggccacccccgccaagggtctgcccatccgactccacccccaccaggtg

SEQ ID NO: 167 - DNA, 1575 bp, Arabidopsis thaliana
atggagtctctggttgtccacaccgtcaacgccatctggtgcattgtcattgtcggtatcttctccgtcggctaccacgtctacggccgagctgttgtcgagcagtggcgaatgcgacgatctctcaagctccagggtgtcaagggtcctcctccctccatcttcaacggtaacgtttccgagatgcagcgaatccagtccgaggccaagcactgctccggtgacaacatcatctcccacgactactcttcttctctgttcccccactttgaccactggcgaaagcagtacggccgaatctacacctactccactggcctcaagcagcacctctacatcaaccaccccgagatggtcaaggagctctcccagaccaacaccctcaacctcggccgaatcacccacatcaccaagcgactcaaccccattctcggtaacggtatcatcacctccaacggcccccactgggcccaccagcgacgaatcattgcctacgagttcacccacgacaagatcaagggtatggtcggtctgatggtcgagtccgccatgcccatgctcaacaagtgggaggagatggtcaagcgaggtggtgagatgggctgtgacatccgagtcgacgaggacctcaaggatgtctccgctgacgtcattgccaaggcctgtttcggctcttccttctccaagggcaaggccatcttctccatgatccgagatctgctcaccgccatcaccaagcgatccgtcctcttccgattcaacggtttcaccgacatggttttcggctccaagaagcacggtgacgttgacattgacgctctcgagatggagctcgagtcctccatctgggagactgtcaaggagcgagagattgagtgcaaggacacccacaagaaggacctcatgcagctcattctcgagggtgccatgcgatcttgtgacggtaacctgtgggacaagtctgcttaccgacgattcgttgtcgacaactgcaagtccatctactttgccggccacgactccaccgccgtttccgtttcttggtgcctcatgctgctcgctctcaacccctcttggcaggtcaagatccgagatgagattctgtcctcctgcaagaacggtatccccgacgccgagtccatccccaacctcaagaccgtcaccatggtcatccaggagactatgcgactctaccctcccgctcccattgtcggccgagaggcctccaaggacattcgactcggtgatctggttgtccccaagggtgtctgtatctggaccctcatccccgctctgcaccgagatcccgagatctggggtcccgacgccaacgacttcaagcccgagcgattctccgagggtatctccaaggcctgcaagtacccccagtcctacatcccctttggcctcggcccccgaacctgtgtcggcaagaactttggtatgatggaggtcaaggtcctcgtttctctgattgtctccaagttctccttcactctgtctcccacctaccagcactctccctcccacaagctgctcgtcgagccccagcacggtgttgtcatccgagttgta

SEQ ID NO: 168 - DNA, 1437 bp, Ixeris dentata
atggacgccgttgccgtcaactccgagactatgtcccacgttgtctttatccccttccccgcccagtcccacatcaagtgcatgctcaagctcgcccgactgctgcaccacaagggtctgcacatcacctttgtcaacaccgagctcaaccacaaccagctgctgtcctccggtggtcccaactctctcgacggtgagcccggtttccgattcaagaccatccccgatggtgtccccgagggtgctcccgacttcatgtacgctctgtgtgactccgttctcaacaagatgctcgaccccttcgtcgatctcattggccgactcgagtcccccgccacctgtatcatcggtgacggtatgatgcccttcactgttgctgctgccgagaagctcaagctccccatcatgcacttctggaccttccccgctgctgccttcctcggctactaccaggcccccaacctcattgagaagggcttcatccctcccaaggacgagtcttggtccaccaacggctacctcgagactgttgtcgactccatctccggtctggagggtttccgaatccgagacatccccgcctacttccgaaccaccgaccccaacgactccgacttcaactacatcattgagtgtgtcaaggccatccgaaaggtttccaacattgttctccacacctttgaggagctcgagtccaccatcatcaaggctctgcagcccatgatcccccacgtctacaccattggccccctcgagctcctcctcaaccccatcaagctcgaagaggagactgagaagctcgatatcaagggctactctctgtggaaggaagatgacgagtgcctcaagtggctcgactccaaggagcccaactccgtcatctacgtcaacttcggctctctcatctccatgtccaaggagcagctcgccgagtttggctggggtctggtcaactccaaccactgcttcctctgggtcatccgacgagatctggttgtcggtgactctgctcctctgcctcccgagctcaaggagcgaatcaacgagcgaggtttcattgcctcttggtgcccccaggagaaggtcctcaagcactcctccgtcggtggtttcctcacccactgtggctggggctccatcatcgagtctctgtccgccggtgtccccatgctctgctggccctacctctgggaccagcccaccaactgccgacaggcctgcaaggagtgggaggtcggtctggagattgagggtaacgtcaacaaggacgaggtcgagcgactcacccgagagctcattggtggtgagaagggcaagcagatgcgatccaaggccctcgagtggaagaagaagattgagattgccaccggccccaagggctcttcttctctcaacgtcgagcgactggccaacgacatcaacatgttctcccgaaat

SEQ ID NO: 169 - DNA, 1446 bp, Ricinus communis
atgggctccattgtccgagatcacgacaagccccacgttgtctgtgtcccctaccccgcccagggccacgtcaaccccatggtcaagctcgccaagctcctccactacaacgacttccacgtcacctttgtcaacaccgagtacaaccaccgacgactcctcaactcccgaggcccctcttctctcgacggcctccccgacttccgattcgaggccatctccgacggtctgcccccttccgacgccaacgccacccaggatatcccctctctctgtgactccacctccaagaactctctggcccccttccgaaacctgctgctcaagctcaagtcctccgactctctgcctcccgtcacctgtatcatctccgacgcctgcatgtccttcaccctcgatgctgctgaggagttcggtatccccgagatcctcttctggaccccctcttcttgtggtgttctcggctactcccagtaccacactctcattgagaagggtctgactcccctcaaggacgcctcctacctgaccaacggctacctcgagactaccctcgactggatccccggtatgaaggacatccgattccgagatctgccctctttcatccgaaccaccgaccgaaacgacatcatgctcaacttcgttgtccgagagctcgagcgaacctcccgagcctctgctgttgttttcaacaccttctacgcctttgagaaggacgttctcgacgttctgtccaccatgttccctcccatctactccatcggtcccctccagctcctcgtcgaccagatccccattgaccgaaacctcggtaacattggctccaacctgtggaaggagcagcccgagtgcattgactggctcgacaccaaggagcccaactccgttgtctacgtcaactttggctccatcaccgtcatcactccccagcagatgattgagtttgcctggggtctggcctcttccaagaagcccttcctgtggatcatccgacccgatctggtcattggtgagaacgccatgctccccgctgagtttgtctccgagactaaggaccgaggtatgctcgcctcttggggtccccaggagcagatcctcaagcaccccgctgtcggtggtttcctgtcccacatgggctggaactccaccctcgactccatgtccggtggtgtccccatggtctgctggcccttcttcgccgagcagcagaccaactgccgattcgcctgcaccgagtggggtgtcggtatggagattgacaacaacgtcaagcgagatgaggtcaagaagctcgttgaggtcctcatggacggcaagaagggcaaggagatgaagtccaaggccatggagtggaaaaccaaggctgaggaagctgccaagcccggtggttcctcccacaacaacctcgaccgactcgtcaagttcatcaagggccagaagaat

SEQ ID NO: 170 - DNA, 1374 bp, Ixeris dentata
atggccgaggagcacaacaagaccaacaactcctctccccacgttgtcatcttccccttcccctcccagggccacatcaaccccctcatccagtttgccaagcgactctcctccaagggtgtcaagcccactctcatcaccaccatctacattgccaagacctctccttaccccaactcctccattgttgtcgagcccatctccgacggtttcgacgacggtggtttcaagtccgccacctccgctgagtcctacattgacaccttccaccaggtcggctccaagtctctggccaacctcatccgaaagctcgtcaacgagggcaaccacgttgatgccatcatctacgactccttcgtcacctgggctctcgatgttgccatggagtacggtattgacggtggctgcttcttcacccaggcctgtgccgtcaacaacatctactaccacgtctacaagggtgtcctcgagatccccctgcaggctgctgctcctcccaccgtcaccattctgctccccgagctcccccagctccagctgtgggagactccctcttttgtccacaaccccggcccctaccccggctgggcccacattgtctttaaccagttccccaacatccacaacgcccgatgggttttctccaacaccttcttcaagctcgaggagcaggtcatcaagtggatgcgactcatgtggcctctcatggtcgtcggtcccaccgtcccctccatgtacctcgacaagcgactcgaggacgacgacgactacggtatgtctctgctcaagcccaaccacattgagtgcatgggctggctcaacaacaagcccaagggctccgtcgtctacgtttctttcggctcttacggtgagctcggtgttgcccagatggaggagattgcctggggtctgaacgagtcctccgtcaactacctgtgggttgtccgagagactgagaaggagaagctccccaagtccttcctggccaacggtctgattgtcgagtggtgccgacagctcgaggtcctcgcccacgaggctgttggctgtttcgtcacccactgcggtttcaactcctctctcgagactatctctctcggtgtccccgttgttgccatcccccagtggaccgaccagaccaccaacgccaagtgcctcgaggatatctggggtgtcggtatccgagccaagacccccgtcacccgaaccaacctggtctggtgcatcaaggagatcatggagggtgagcgaggtgctgttgctcgaaagaacgccatcaagtggaaggatctggccattgaggctgtctcccccggcggctcttccgacaaggacatcaacgagtttgtctcccagctctcccccatcaagtgt

SEQ ID NO: 171 - DNA, 1362 bp, Populus trichocarpa
atggacaacaagaagtcccacgtcattgttctgacctaccccgcccagggccacatcaaccccctgctccagtttgccaagcgactcgcctccaagggcctcaaggccactctggccaccacctactacaccgtcaactccatcgacgcccccaccgtcggtgttgagcccatctccgacggtttcgacgagggtggtttcaagcaggcttcttctctcgatgtctacctcgagtccttcaagaccgtcggctcccgaactctgaccgagctcgttttcaagttcaaggcttccggctctcccgtcaactgtgttgtctacgactccatgctcccctgggccctcgacgttgctcgagatctcggtatctacgctgctgccttcatgaccacctctgcttccgtctgctccatgtactggcgaatcgatctcggtctgctgtctctgcccctcaagcagcagaccgccactgtctctctgcccggtctgccccctctcggctgctgtgacctcccctctttcctcgccgagcccacctcccagaccgcctacctcgaggtcatcatggagaagttccactctctcaacgaggacgactgggttttctgcaactccttcgaggacctcgagattgagctcgtcaaggccatgcgaggcaagtggcccctcgtcatggtcggccccatggtcccctccgcctacctcgaccagcagatcgacggtgaccgagcctacggtgcttctctgtggaagcccacctcctcccagtgcttcacctggctcgacaccaagccccctcgatccgtcatctacgtttccttcggctccatgggcaacatctccgccgagcaggttgaggagattgcctggggcctcaaggcttccaaccgacccttcctgtgggtcatgaaggagtccgagaagaagctccccaccggtttcctcaactccgtcggtgagactggtatggttgtctcttggtgcaaccagctcgaggttctcgcccaccaggccattggctgctttgtcacccactgtggctggaactccactctcgagggtctgggcctcggtgtccccatggtctgtgtcaccgagcgatccgaccagcccatgaacgccaagttcgtcgaggatgtctggaaggtcggtgtccgagccaagaaggacgaggttggtattgtcacccgagaggagctcgagaagtgcatccgaggtgtcatggacggtgagaacggtgaggagatcaagcgaaacgccaacaagtggcgagagctcgcccgatctgctgtttccgtcggtggttcctccgacatgaacatcaacgagtttgttgtcaagctgctcgagggcaagaaggga

SEQ ID NO: 172 - DNA, 1377 bp, Nicotiana tabacum
atgaccacccagaaggcccactgtctgatcctcccctaccccgcccagggccacatcaaccccatgctccagttctccaagcgactccagtccaagggtgtcaagatcaccattgctgccaccaagtctttcctcaagaccatgcaggagctgtccacctctgtctccgtcgaggccatctccgacggctacgacgacggtggccgagagcaggctggtacctttgtcgcctacatcacccgattcaaagaggttggctccgacactctgtcccagctcatcggtaagctcaccaactgtggctgccctgtctcttgcattgtctacgaccccttcctgccctgggctgtcgaggtcggtaacaacttcggtgttgccactgctgccttcttcacccagtcttgtgccgtcgacaacatctactaccacgtccacaagggtgttctcaagctccctcccaccgacgttgacaaggagatctccatccccggtctgctcaccattgaggcttccgatgtcccctcttttgtctccaaccccgagtcctcccgaatcctcgagatgctcgtcaaccagttctccaacctcgagaacaccgactgggttctcatcaactccttctacgagctcgagaaggaagtcattgactggatggccaagatctaccccatcaagaccattggccccaccatcccctccatgtacctcgacaagcgactccccgatgacaaggagtacggtctgtccgtctttaagcccatgaccaacgcctgcctcaactggctcaaccaccagcccgtttcttccgtcgtctacgtttctttcggctctctggccaagctcgaggctgagcagatggaggagctcgcctggggtctgtccaactccaacaagaacttcctgtgggttgtccgatccactgaggagtccaagctccccaacaacttcctcgaggagctcgcctccgagaagggtctggttgtctcttggtgcccccagctccaggttctcgagcacaagtccatcggttgcttcctgacccactgcggctggaactccactctcgaggccatctctctcggtgtccccatgattgccatgccccactggtccgaccagcccaccaacgccaagctcgtcgaggatgtctgggagatgggtatccgacccaagcaggatgagaagggtctggtccgacgagaggtcattgaggagtgtatcaagattgtcatggaggagaagaagggcaagaagatccgagagaacgccaagaagtggaaggagctcgcccgaaaggctgttgacgagggtggctcttccgaccgaaacattgaggagttcgtttccaagctcgtcaccatcgcttccgtcgaatcg

SEQ ID NO: 173 - DNA, 1434 bp, Vaccaria hispanica
atgtccaacaacgagaacaacgccacccaggtcattgttctgccctaccacggccagggccacatgaacaccatggtccagtttgccaagcgactcgcctggaagggtgtccacgtcaccatcgccaccaccttcaacaccatccagcagatgaagctcaacatctcctcttacaactccatcactctcgagcccatctacgacgacaccgacgactccactctgcacatcaaggaccgaatggcccgattcgaggctgaggctgcctccaacctgacccgagttctcgaggccaagaagcagcagcaggctctcaacaagaagtgtctgctcgtctaccacggctctctcaactgggccctcgttgtcgcccaccagcagaacgttgccggtgctgccttcttcaccgccgcctctgcttctttcgcctgctactactacctgcacctcgagtcccagggcaagggtgtcgatctcgaggagctcccctccattctgccccctcccaaggtcatcgtccagaagctccccaagtccttcctggcctacggtgacaacaactcccacaacaacaacaataacaacaataacaacaacaataacaacaacatgggtctgcaccctctggttctgtggctcctcaaggactacggcaactccgtcaaggccgactttgtcctcctcaactccttcgacaagctcgaggaagaggccatcaagtggatctccaacatctgctccgtcaagaccatcggtcccaccatcccctccacctacctcgacaagcagatcgagaacgatgtcgactacggtttcaaccagtacaagcccaccaacgaggactgcatgaagtggctcgacaccaaggaagccaactccgttgtctacattgccttcggctctgttgctcgactgtccgtcgagcagatggccgagattgccaaggctctcgaccactcctccaagtctttcatctgggttgtccgagagactgagaaggagaagctccccgtcgacctcgtcgagaagatctccggccagggtatggttgtcccctgggctccccagctcgaggtcctcgcccacgatgctgtcggctgtttcgtttcccactgtggctggaactccaccattgaggctctgtctttcggtgtccccatcctcgccatgccccagttcctcgaccagctcgttgatgcccactttgtcgaccgagtctggggtgtcggtattgcccccactgtcgacgagaacgatctcgtcacccaggaagagatctcccgatgcctcgacgagatgatgggtggtggtcccgagggtgagaagatcaagaagaacgttgccatgtggaaggagctgaccaaagaggctctcgacaagggtggctcttccgacaagcacattgacgagatcattgagtggctctcttctagt

SEQ ID NO: 174 - DNA, 1443 bp, Streptococcus mutans
atgcccatcatcaacaagaccatgctcatcacctacgccgactctctcggcaagaacctcaaggagctcaacgagaacattgagaactacttcggtgatgctgttggtggtgtccacctgctccccttcttcccctccactggtgaccgaggcttcgcccccattgactaccacgaggttgactctgccttcggtgactgggatgatgtcaagtgcctcggtgagaagtactacctcatgttcgacttcatgatcaaccacatctcccgacagtccaagtactacaaggactaccaggagaagcacgaggcttctgcctacaaggacctcttcctcaactgggacaagttctggcccaagaaccgacctacccaggaagatgtcgatctcatctacaagcgaaaggaccgagctcccaagcaggagatccagtttgccgacggctccgtcgagcacctgtggaacaccttcggtgaggagcagattgacctcgatgtcaccaaggaagtcaccatggacttcatccgatccaccattgagaacctggctgccaacggctgtgacctcatccgactcgacgcctttgcctacgccgtcaagaagctcgacaccaacgacttcttcgtcgagcccgagatctggactctgctcgacaaggtccgagacattgctgccgtttccggtgccgagatcctccccgagatccacgagcactacaccatccagttcaagattgctgaccacgactactacgtctacgactttgctctgcccatggtcactctgtactctctgtactcctccaaggtcgaccgactcgccaagtggctcaagatgtctcccatgaagcagttcaccaccctcgacacccacgacggtatcggtgttgttgatgtcaaggacattctgaccgacgaggagatcacctacacctccaacgagctctacaaggtcggtgccaacgtcaaccgaaagtactccactgccgagtacaacaacctcgatatctaccagatcaactccacctactactctgctctcggtgacgacgaccagaagtacttcctggcccgactcatccaggcctttgcccccggtatcccccaggtctactacgttggcttcctcgccggcaagaacgatctcgagctgctcgagtccaccaaagagggccgaaacatcaaccgacactactactcctccgaggagattgctaaagaggtcaagcgacccgttgtcaaggctctgctcaacctcttcacctaccgaaaccagtccgccgcctttgacctcgacggccgaatcgaggttgagactcccaacgaggccaccattgtcatcgagcgacagaacaaggacggctctcacattgccaaggccgagatcaacctgcaggacatgacctaccgagtcaccgagaacgaccagaccatctccttcgag

SEQ ID NO: 175 - DNA, 1392 bp, Lobelia erinus
atggacaacaaccacctcggtgagactctgctccccctcgctcccaagaacggccgacgagttctcttcttcccctaccccctccagggccacatctcccccatgctcaacctcgccaacctgctccactccaagggtttcaccatcaccatcatccacaccaacctcaactcccccaaccagtccgactacccccacttcaccttccgaccctttgacgacggtttccctccttactccaagggctggcagctcgccaccctctgctcccgatgtgtcgagcccttccgagagtgtctggcccagatcttcctgtccgaccacaccgcccccgagggtgagcgagagtccattgcctgcctcattgccgatggtctgtggaacttcctcggtgctgccgtctacaacttcaagctccccatgattgttctgcgaaccggtaacatgtccaacattgttgccaacgtcaagctcccctgcttcatcgagaagggctactttgaccacaccaaggaaggctccaagctcgaggctgccgtccccgagttccccaccatcaagttcaaggacattctcaagacctacggctccaaccccaaggccatctgtgagactctgaccgctctgctcaaggagatgcgagcttcttccggtgtcatctggaactcctgcaaggagctcgagcagtccgagctccagatgatctgcaaggagttccccgtcccccacttcctcatcggtcctctgcacaagtacttccccgcctcttcttcttctctcgttgcccacgacccctcttccatctcttggctcaactccaaggctcccaactccgtcctctacgtttcttttggctccatctcctccatggacgaggctgagttcctcgagactgcctggggtctggccaactccatgcagcagttcctgtgggttgtccgacccggctccgtccgaggttcccagtggctcgagtctctgcccgatggtttcattgacaagctcgacggccgaggccacattgtcaagtgggctccccagcaagaggttctcgcccaccaggccaccggtggtttctggacccactgtggctggaactccactctcgagtccatgtgcgagggtgtccccatgatctgctcccacggtatcatggaccagcccatcaacgcccgatacgtcaccgatgtctggaaggtcggtatcgagctcgagaagggctttgactccgaggagatcaagatggccatccgacgactcatggtcgataaagagggccaggagatccgagagcgatcttctcgactcaaggagtctctgtccaactgtctcaagcagggtggttcctcccacgactccgtcgagtctctggtcgaccacattctcagcttc

SEQ ID NO: 176 - DNA, 1380 bp, Arabidopsis thaliana
atggaggagcgaaagggccgacgaatcatcatgttccctctgcccttccccggccacttcaaccccatgatcgagctcgctggtatcttccaccaccgaggcttctccgtcaccatcctccacacctcctacaacttccccgacccctctcgacacccccacttcaccttccgaaccatctcccacaacaaggaaggcgaagaggaccccctgtcccagtccgagacttcttccatggacctcattgttctcgtccgacgactcaagcagcgatacgctgagcccttccgaaagtccgttgctgctgaggtcggtggtggtgagactgtctgctgcctcgtttccgatgccatctggggtaagaacaccgaggttgttgccgaggagattggtgtccgacgagttgtcctccgaaccggtggtgcctcttctttctgcgcctttgctgctttccctctgctccgagacaagggctacctccccatccaggactcccgactcgacgagcccgtcaccgagctgccccctctcaaggtcaaggatctgcccgtcatggagactaacgagcccgaggagctctaccgagttgtcaacgacatggtcgagggtgccaagtcctcttccggtgtcatctggaacacctttgaggatctcgagcgactctctctcatgaactgctcctccaagctccaggtccccttcttccccatcggtcccttccacaagtactccgaggaccccacccccaagaccgagaacaaggaagataccgactggctcgacaagcaggacccccagtccgttgtctacgcctcttttggctctctcgccgccatcgaggagaaggagttcctcgagattgcctggggtctgcgaaactccgagcgacccttcctgtgggttgtccgacccggctccgtccgaggcaccgagtggctcgagtctctgcccctcggcttcatggagaacattggtgacaagggcaagatcgtcaagtgggccaaccagctcgaggttctggcccaccccgccatcggtgccttctggacccactgtggctggaactccactctcgagtccatctgtgagggtgtccccatgatctgcacctcttgtttcaccgaccagcacgtcaacgcccgatacattgtcgatgtctggcgagtcggtatgctgctcgagcgatccaagatggagaagaaggagattgagaaggtcctccgatccgtcatgatggagaagggtgacggtctgcgagagcgatctctcaagctcaaggagcgagccgacttctgcctctccaaggacggctcctcctccaagtacctcgacaagcttgtctcccacgttctgtcttttgactcctacgcctttgcatcc

SEQ ID NO: 177 - DNA, 2139 bp, Gibberella fujikuroi
atggctgagctcgacactctcgacattgttgttctcggtgtcatcttcctcggtaccgttgcctacttcaccaagggtaagctgtggggtgtcaccaaggacccctacgccaacggctttgctgctggtggtgcctccaagcccggccgaacccgaaacattgttgaggccatggaggagtccggcaagaactgtgttgttttctacggctcccagaccggcaccgccgaggactacgcctctcgactggccaaggaaggcaagtctcgattcggtctgaacaccatgatcgctgatctcgaggactacgactttgacaacctggacaccgtcccctccgacaacatcgtcatgtttgtcctggccacctacggtgagggtgagcccaccgacaacgccgtcgacttctacgagttcatcaccggtgaggacgcttctttcaacgagggtaacgaccctcctctcggcaacctcaactacgttgccttcggtctgggcaacaacacctacgagcactacaactccatggtccgaaacgtcaacaaggctctcgagaagctcggcgcccaccgaatcggtgaggctggtgagggtgacgacggtgccggtaccatggaggaagatttcctggcctggaaggaccccatgtgggaggctctcgccaagaagatgggcctcgaggagcgagaggccgtctacgagcccatctttgccatcaacgagcgagatgatctcacccccgaggccaacgaggtctacctcggtgagcccaacaagctccacctcgagggtaccgccaagggccccttcaactcccacaacccctacattgcccccattgctgagtcctacgagctgttctccgccaaggaccgaaactgtctgcacatggagattgacatctccggctccaacctcaagtacgagactggtgaccacatcgccatctggcccaccaaccccggtgaagaggtcaacaagttcctcgacatcctcgatctctccggcaagcagcactctgttgtcaccgtcaaggctctcgagcccaccgccaaggtccccttccccaaccccaccacctacgacgccatcctgcgataccacctcgagatctgtgcccccgtttctcgacagttcgtttccactctggctgcctttgcccccaacgacgacatcaaggccgagatgaaccgactcggctccgacaaggactacttccacgagaaaaccggtcctcactactacaacattgctcgattcctggcttctgtctccaagggtgagaagtggaccaagatccccttctccgccttcattgagggtctgaccaagctccagccccgatactactccatctcttcttcttctctcgtccagcccaagaagatctccatcaccgctgttgtcgagtcccagcagatccccggccgagatgaccccttccgaggtgttgccaccaactacctcttcgccctcaagcagaagcagaacggtgaccccaaccccgctcccttcggtcagtcttacgagctcaccggcccccgaaacaagtacgacggtatccacgtccccgtccacgtccgacactccaacttcaagctcccctccgaccccggcaagcccatcatcatgattggccccggtactggtgttgctcccttccgaggctttgtccaggagcgagccaagcaggctcgagatggtgtcgaggtcggtaagactctgctcttcttcggctgccgaaagtccaccgaggacttcatgtaccagaaggagtggcaggagtacaaagaggctctcggtgacaagttcgagatgatcaccgccttctcccgagagggctccaagaaggtctacgtccagcaccgactcaaggagcgatccaaggaagtctccgacctcctctcccagaaggcctacttctacgtctgcggtgacgccgcccacatggcccgagaggtcaacaccgttctggcccagatcattgccgagggccgaggtgtctccgaggccaagggcgaggagattgtcaagaacatgcgatctgccaaccagtaccaggtctgctccgactttgtcaccctccactgcaaggagactacttacgccaactccgagctccaggaagatgtctggtct

SEQ ID NO: 178 - DNA, 2076 bp, Arabidopsis thaliana
atgacctctgctctctacgcctccgatctcttcaagcagctcaagtccatcatgggtaccgactccctgtccgacgatgtcgttctggtcattgccaccacctctctggctctggtcgccggtttcgttgtcctcctctggaagaaaaccaccgctgaccgatccggcgagctcaagcccctcatgatccccaagtctctcatggccaaggacgaggacgacgatctcgatctcggttccggcaagacccgagtctccatcttctttggcacccagaccggtaccgccgagggtttcgccaaggctctctccgaggagatcaaggcccgatacgagaaggccgccgtcaaggtcatcgacctcgacgactacgctgctgacgacgaccagtacgaggagaagctcaagaaggagactctcgccttcttctgtgtcgccacctacggtgacggcgagcccaccgacaacgccgcccgattctacaagtggttcaccgaggagaacgagcgagacatcaagctccagcagctggcctacggtgttttcgccctcggcaaccgacagtacgagcacttcaacaagatcggtattgtcctcgacgaggagctctgcaagaagggtgccaagcgactcattgaggttggtctgggtgatgatgaccagtccattgaggacgacttcaacgcctggaaggagtctctgtggtccgagctcgacaagctgctcaaggacgaggacgacaagtccgttgccaccccctacaccgccgtcatccccgagtaccgagtcgtcacccacgacccccgattcaccacccagaagtccatggagtccaacgttgccaacggtaacaccaccattgacatccaccacccctgccgagtcgacgttgccgtccagaaggagctccacacccacgagtccgaccgatcttgtatccacctcgagtttgacatctcccgaaccggtatcacctacgagactggtgaccacgttggtgtctacgccgagaaccacgttgagattgtcgaggaagctggtaagctgctcggccactctctcgacctcgttttctccatccacgccgacaaagaggacggctctcccctcgagtccgctgttccccctcccttccccggcccctgcactctcggcaccggtctggcccgatacgctgacctcctcaaccctccccgaaagtccgctctggttgctctcgccgcctacgccaccgagccctccgaggccgagaagctcaagcacctgacctcccccgacggcaaggacgagtactcccagtggatcgttgcttcccagcgatctctgctcgaggtcatggccgccttcccctctgccaagccccctctgggtgttttctttgccgccattgctccccgactccagccccgatactactccatctcctcctctccccgactcgccccctctcgagtccacgtcacctctgctctcgtctacggtcccactcccactggccgaatccacaagggtgtctgctccacctggatgaagaacgccgtccccgctgagaagtcccacgagtgctccggtgctcccatcttcatccgagcctccaacttcaagctcccctccaacccctccacccccattgtcatggtcggccccggtactggtctggcccccttccgaggcttcctccaggagcgaatggctctcaaggaagatggtgaggagctcggctcttctctgctcttctttggctgccgaaaccgacagatggacttcatctacgaggacgagctcaacaactttgtcgaccagggtgtcatctccgagctcatcatggccttctcccgagagggtgcccagaaggagtacgtccagcacaagatgatggagaaggccgcccaggtctgggatctcatcaaggaagagggctacctctacgtctgtggtgacgccaagggcatggcccgagatgtccaccgaactctgcacaccattgtccaggagcaggaaggtgtctcttcctccgaggctgaggccattgtcaagaagctgcagaccgagggccgatacctgcgagatgtatgg

SEQ ID NO: 179 - DNA, 2133 bp, Arabidopsis thaliana
atgtcctcctcttcttcttcttccacctccatgattgatctcatggctgccatcatcaagggtgagcccgtcattgtctccgaccccgccaacgcctccgcctacgagtccgttgctgccgagctgtcctccatgctcatcgagaaccgacagtttgccatgatcgtcaccacctccattgctgttctcattggctgcattgtcatgctcgtctggcgacgatctggctccggtaactccaagcgagtcgagcccctcaagcccctggtcatcaagccccgagaagaggagatcgacgacggccgaaagaaggtcaccatcttctttggcacccagaccggtactgctgagggcttcgccaaggctctcggtgaggaagccaaggctcgatacgaaaagacccgattcaagattgtcgacctcgatgattacgctgccgatgacgacgagtacgaggagaagctcaagaaagaggacgttgccttcttcttcctcgccacctacggtgacggtgagcccaccgacaacgctgcccgattctacaagtggttcaccgagggtaacgaccgaggcgagtggctcaagaacctcaagtacggtgttttcggtctgggcaaccgacagtacgagcacttcaacaaggttgccaaggttgtcgacgacatcctcgtcgagcagggtgcccagcgactcgtccaggtcggcctcggtgatgatgaccagtgcatcgaggacgacttcactgcctggcgagaggctctgtggcccgagctcgacaccattctgcgagaggaaggtgacaccgccgttgccaccccctacaccgccgccgtcctcgagtaccgagtctccatccacgactccgaggatgccaagttcaacgacatcaacatggccaacggtaacggctacaccgtctttgacgcccagcacccctacaaggccaacgtcgccgtcaagcgagagctccacacccccgagtccgaccgatcttgtatccacctcgagtttgacattgctggttccggtctgacctacgagactggtgaccacgttggtgtcctctgtgacaacctgtccgagactgtcgacgaggctctgcgactcctcgacatgtcccccgacacttacttctctctgcacgccgagaaagaggacggtactcccatctcttcttctctgccccctcccttccctccctgcaacctgcgaaccgctctgacccgatacgcctgcctcctctcttctcccaagaagtctgctctcgttgctctggccgcccacgcctccgaccccaccgaggctgagcgactcaagcacctcgcctctcccgctggcaaggacgagtactccaagtgggttgtcgagtcccagcgatctctgctcgaggtcatggccgagttcccctccgccaagccccctctcggtgttttcttcgccggtgttgctccccgactccagccccgattctactccatctcctcttcccccaagatcgccgagactcgaatccacgttacctgtgctctggtctacgagaagatgcccaccggccgaatccacaagggtgtctgctccacctggatgaagaacgccgttccctacgagaagtccgagaactgttcctctgctcccatctttgtccgacagtccaacttcaagctcccctccgactccaaggtccccatcatcatgattggccccggtaccggcctcgcccccttccgaggcttcctgcaggagcgactcgccctcgtcgagtccggtgtcgagctcggcccctccgtcctcttctttggctgccgaaaccgacgaatggacttcatctacgaagaggagctccagcgattcgtcgagtccggtgctctcgccgagctctccgttgccttctcccgagagggtcccaccaaggagtacgtccagcacaagatgatggacaaggcctccgacatctggaacatgatctcccagggcgcctacctctacgtctgcggtgacgccaagggtatggcccgagatgtccaccgatctctgcacaccattgcccaggagcagggctccatggactccaccaaggccgagggtttcgtcaagaacctccagacctccggccgatacctccgagatgtctgg

SEQ ID NO: 180 - DNA, 1575 bp, Gibberella fujikuroi
atgtccaagtccaactccatgaactccacctcccacgagactctcttccagcagctcgttctcggcctcgaccgaatgcccctcatggacgtccactggctcatctacgttgcctttggtgcctggctctgctcctacgtcatccacgttctgtcctcttcctccactgtcaaggtccccgtcgtcggttaccgatccgttttcgagcccacctggctcctccgactgcgattcgtctgggagggtggttccatcattggccagggctacaacaagttcaaggactccatcttccaggtccgaaagctcggtaccgacattgtcatcatccctcccaactacattgacgaggtccgaaagctctcccaggacaagacccgatccgtcgagcccttcatcaacgactttgccggccagtacacccgaggtatggtctttctgcagtccgatctccagaaccgagtcatccagcagcgactcacccccaagcttgtctctctcaccaaggtcatgaaggaagagctcgactacgctctgaccaaggagatgcccgacatgaagaacgacgagtgggttgaggtcgacatctcttccatcatggtccgactcatctctcgaatctccgcccgagttttcctcggccccgagcactgccgaaaccaggagtggctcaccaccaccgccgagtactccgagtctctcttcatcaccggcttcatcctccgagttgtcccccacattctccgacccttcattgctcctctgctgccctcttaccgaaccctgctgcgaaacgtttcttccggccgacgagtcattggtgatatcatccgatcccagcagggtgacggtaacgaggacatcctctcttggatgcgagatgctgccactggtgaggagaagcagatcgacaacattgcccagcgaatgctcattctgtctctcgcctccatccacaccaccgccatgaccatgacccacgccatgtacgatctgtgtgcctgccccgagtacattgagcccctccgagatgaggtcaagtccgtcgttggtgcttctggctgggacaagaccgctctcaaccgattccacaagctcgactctttcctcaaggagtcccagcgattcaaccccgttttcctgctcaccttcaaccgaatctaccaccagtccatgaccctctccgatggtaccaacatcccctccggtacccgaattgctgtcccctctcacgccatgctccaggactccgcccacgtccccggtcccactcctcccactgagttcgacggtttccgatactccaagatccgatccgactccaactacgcccagaagtacctcttctccatgaccgactcttccaacatggcctttggctacggtaagtacgcctgccccggccgattctacgcctccaacgagatgaagctgactctggccattctgctcctccagtttgagttcaagctccccgacggtaagggccgaccccgaaacatcaccatcgactccgacatgatccccgacccccgagctcgactctgtgtccgaaagcgatctctgcgtgacgag

SEQ ID NO: 181 - DNA, 1419 bp, Stevia rebaudiana
atggccacctccgactccattgtcgacgaccgaaagcagctgcacgttgccaccttcccctggctcgcctttggccacattctgccctacctccagctctccaagctcattgctgagaagggccacaaggtttctttcctgtccaccacccgaaacatccagcgactctcctcccacatctctcctctcatcaacgttgtccagctcaccctcccccgagtccaggagctccccgaggatgccgaggccaccactgatgtccaccccgaggacatcccctacctcaagaaggcctccgacggtctgcagcccgaggtcacccgattcctcgagcagcactctcccgactggatcatctacgactacacccactactggctcccctccattgctgcttctctcggtatctctcgagcccacttctccgtcaccaccccctgggccattgcttacatgggcccctctgctgacgccatgatcaacggttccgacggccgaaccaccgtcgaggatctcaccacccctcccaagtggttccccttccccaccaaggtctgctggcgaaagcacgatctcgcccgactcgtcccctacaaggcccccggtatctccgacggttaccgaatgggtctggttctcaagggctccgactgtctgctctccaagtgctaccacgagtttggtacccagtggctccccctgctcgagactctgcaccaggtccccgttgtccccgtcggtctgctccctcccgagatccccggtgacgagaaggacgagacttgggtttccatcaagaagtggctcgacggcaagcagaagggctccgtcgtctacgttgctctcggctccgaggttcttgtctcccagactgaggtcgtcgagctcgccctcggtctggagctctccggtctgcccttcgtctgggcctaccgaaagcccaagggtcccgccaagtccgactccgtcgagctccccgacggtttcgtcgagcgaactcgagatcgaggtctggtctggacctcttgggctccccagctccgaatcctctcccacgagtccgtctgcggtttcctgacccactgtggttccggctccattgtcgagggcctcatgttcggccaccccctcatcatgctgcccatcttcggtgaccagcccctcaacgcccgactcctcgaggacaagcaggtcggtatcgagatcccccgaaacgaagaggacggctgcctcaccaaggagtctgttgcccgatctctgcgatctgttgttgtcgagaaagagggtgagatctacaaggccaacgcccgagagctctccaagatctacaacgacaccaaggtcgagaaggagtacgtttcccagtttgtcgactacctcgagaagaacgcccgagctgtcgccattgaccacgagagt

SEQ ID NO: 182 - DNA, 2552 bp, Artificial sequence
  tCPS-cwpT
cccactagttataaagtcacaagtatctcagtatacccgtctaaccacacatttatcaccatgtgcaaggctgtttccaaggagtactccgatctgctccagaaggacgaggcctctttcaccaagtgggacgacgacaaggtcaaggaccacctcgacaccaacaagaacctctaccccaacgacgagatcaaggagtttgtcgagtccgtcaaggccatgttcggctccatgaacgacggcgagattaatgtctctgcttacgacaccgcctgggttgctctggtccaggatgtcgacggttccggctctcctcagttcccttcctctctcgagtggatcgccaacaaccagctgtccgacggttcttggggtgaccacctgctcttctctgctcacgaccgaatcatcaacaccctggcctgtgtcattgctctgacctcttggaacgtccacccctccaagtgcgagaagggtctgaacttcctccgagagaacatctgcaagctcgaggacgagaacgccgagcacatgcccattggcttcgaggtcaccttcccctctctgattgacattgccaagaagctcaacattgaggtccccgaggacacccccgctctcaaggagatctacgctcgacgagacatcaagctcaccaagatccccatggaggttctccacaaggtccccaccactctcctccactctctcgagggtatgcccgatctcgagtgggagaagctgctcaagctgcagtgcaaggacggctctttcctcttctccccctcttccactgccttcgccctcatgcagaccaaggacgagaagtgtctccagtacctcaccaacattgtcaccaagttcaacggtggtgtccccaacgtctaccccgttgacctctttgagcacatctgggttgttgaccgactccagcgactcggtatcgcccgatacttcaagtccgagatcaaggactgtgtcgagtacatcaacaagtactggaccaagaacggtatctgctgggcccgaaacacccacgtccaggacattgacgacaccgccatgggcttccgagttctgcgagcccacggctacgatgtcacccccgatgtctttcgacagtttgagaaggacggcaagtttgtctgtttcgccggtcagtccacccaggccgtcaccggtatgttcaacgtctaccgagcttctcagatgctcttccccggtgagcgaatcctcgaggacgccaagaagttctcctacaactacctcaaggagaagcagtccaccaacgagctgctcgacaagtggatcattgccaaggatctgcccggtgaggttggctacgccctcgacatcccctggtacgcctctctgccccgactggagactcgatactacctcgagcagtacggtggtgaggacgatgtctggatcggtaagaccctgtaccgaatgggctacgtttccaacaacacctacctcgagatggccaagctcgactacaacaactacgttgccgtcctccagctcgagtggtacaccatccagcagtggtacgtcgacattggtatcgagaagttcgagtccgacaacatcaagtccgtccttgtctcctactacctcgctgctgcctccatcttcgagcccgagcgatccaaggagcgaattgcctgggccaagaccaccatcctcgtcgacaagatcacctccatcttcgactcctcccagtcctccaaggaagatatcaccgccttcattgacaagttccgaaacaagtcctcctccaagaagcactccatcaacggcgagccctggcacgaggtcatggttgctctcaagaaaactctccacggctttgccctcgacgctctgatgacccactctcaggacatccacccccagctccaccaggcctgggagatgtggctcaccaagctccaggacggtgttgatgtcactgctgagctcatggtccagatgatcaacatgaccgccggccgatgggtttccaaggagctcctcacccacccccagtaccagcgactctccactgtcaccaactctgtctgccacgacatcaccaagctccacaacttcaaggagaactccaccaccgtcgactccaaggtccaggagctggtccagctcgttttctccgacacccccgatgatctcgaccaggacatgaagcagaccttcctgactgtcatgaaaactttctactacaaggcctggtgcgaccccaacaccatcaacgaccacatctccaaggtctttgagattgtgatttaagttttttgatcaatgatccaatggctttcacatacccccccacgcctataattaaaacacagagaaatataatctaacttaataaatattacggagaatctttcgagtgttcagcagaaatatagccattgtaacaaaagccggctatcgaccgctttatcgaagaatatttcccgccccccagtggccaaacgatatcgaaacaaaagagctgaaatcatatccttcagtagtagtatagtcctgttatcacagcatca

SEQ ID NO: 183 - DNA, 2394 bp, Artificial sequence
  tKS
agatatacaagcaatgtcactctccttcgtactcgtacatacaacacaactacattcaaaatgacctcccacggcggccagaccaaccccaccaacctcatcattgacaccaccaaggagcgaatccagaagcagttcaagaacgtcgagatctccgtttcctcctacgacaccgcctgggtcgccatggtcccctctcccaactcccccaagtctccctgcttccccgagtgtctcaactggctcatcaacaaccagctcaacgacggctcttggggtctggtcaaccacacccacaaccacaaccaccccctcctcaaggactctctctcttccactctcgcctgcattgttgctctcaagcgatggaacgttggcgaggaccagatcaacaagggtctgtctttcattgagtccaacctcgcctccgccaccgagaagtcccagccctcccccattggctttgatatcatcttccccggtctgctcgagtacgccaagaacctcgatatcaacctgctctccaagcagaccgacttctctctcatgctgcacaagcgagagctcgagcagaagcgatgccactccaacgagatggacggctacctggcctacatttccgagggtctgggtaacctctacgactggaacatggtcaagaagtaccagatgaagaacggttccgttttcaactccccctctgccaccgctgctgccttcatcaaccaccagaaccccggctgtctcaactacctcaactctctgctcgacaagtttggtaacgccgtccccactgtctacccccacgatctcttcatccgactctccatggtcgacaccattgagcgactcggtatttcccaccacttccgagtcgagatcaagaacgttctcgatgagacttaccgatgctgggttgagcgagatgagcagatcttcatggacgttgtcacctgtgctctggccttccgactcctccgaatcaacggttacgaggtttcccccgaccccctcgccgagatcaccaacgagctggctctcaaggacgagtacgccgccctcgagacttaccacgcttctcacattctgtaccaagaggatctgtcctccggcaagcagattctcaagtccgccgacttcctcaaggagatcatctccactgactccaaccgactctccaagctcatccacaaggaagtcgagaacgctctcaagttccccatcaacaccggtctggagcgaatcaacacccgacgaaacatccagctctacaacgtcgacaacacccgaattctcaagaccacctaccactcttccaacatctccaacaccgactacctgcgactcgccgtcgaggacttctacacctgccagtccatctaccgagaggagctcaagggtctggagcgatgggttgtcgagaacaagctcgaccagctcaagtttgcccgacaaaagactgcctactgctacttctccgttgctgccaccctctcttctcccgagctctccgacgcccgaatctcttgggccaagaacggtatcctgaccactgttgtcgacgacttctttgacattggtggcaccattgacgagctgaccaacctcatccagtgcgtcgagaagtggaacgtcgacgttgacaaggactgttgttccgagcacgtccgaatcctcttcctggctctcaaggacgccatctgctggatcggtgacgaggccttcaagtggcaggctcgagatgtcacttcccacgtcatccagacctggctcgagctcatgaactccatgctgcgagaggccatctggacccgagatgcctacgtccccaccctcaacgagtacatggagaacgcctacgtcagctttgctctcggtcccattgtcaagcccgccatctactttgtcggtcccaagctgtccgaggagattgtcgagtcctccgagtaccacaacctcttcaagctcatgtccacccagggccgactcctcaacgatatccactccttcaagcgagagttcaaggaaggtaagctcaacgccgttgctctgcacctgtccaacggtgagtccggcaaggtcgaggaagaggtcgtcgaggagatgatgatgatgatcaagaacaagcgaaaggagctcatgaagctcatcttcgaggagaacggctccattgtcccccgagcctgcaaggacgccttctggaacatgtgccacgtcctcaacttcttctacgccaacgacgacggtttcaccggcaacaccattctcgacaccgtcaaggacatcatctacaaccctctggttctggtcaacgagaacgaggagcagaggtaactatccgaagatcaagagcgaagcaagttgtaagtccaggacatgtttcccgcccacgcg

SEQ ID NO: 184 - DNA, 2979 bp, Artificial sequence
  CPSKS
cccactagttataaagtcacaagtatctcagtatacccgtctaaccacacatttatcaccatgcccggcaagattgagaacggtacccccaaggacctcaagaccggcaacgacttcgtttccgctgccaagtctctgctcgaccgagccttcaagtcccaccactcctactacggtctgtgctccacttcctgccaggtctacgacaccgcctgggttgccatgatccccaagacccgagacaacgtcaagcagtggctcttccccgagtgtttccactacctgctcaagacccaggctgctgacggctcttggggctctctgcccaccacccagaccgccggtatcctcgacactgcctccgccgttctggctctgctctgccacgcccaggagcctctgcagatcctcgatgtctcccccgatgagatgggtctgcgaatcgagcacggtgtcacttctctcaagcgacagctcgccgtctggaacgacgttgaggacaccaaccacattggtgtcgagttcatcatccccgctctgctctccatgctcgagaaggagctcgatgtcccctccttcgagttcccttgccgatccattctggagcgaatgcacggcgagaagctcggtcactttgatctcgagcaggtctacggcaagccctcttctctgctgcactctctcgaggccttcctcggcaagctcgatttcgaccgactctcccaccacctctaccacggctccatgatggcctccccctcttccaccgccgcctacctcattggtgccaccaagtgggacgacgaggccgaggactacctccgacacgtcatgcgaaacggtgccggccacggtaacggtggtatctctggtaccttccccaccacccactttgagtgctcctggatcattgccactctcctcaaggtcggtttcactctcaagcagattgacggtgacggtctgcgaggcctctccaccattctcctcgaggctctgcgtgacgagaacggtgtcattggcttcgctccccgaaccgccgacgttgatgacactgccaaggctctgctggctctgtctctggtcaaccagcccgtttcccccgacatcatgatcaaggttttcgagggtaaggaccacttcaccacctttggctccgagcgagatccctctctgacctccaacctccacgttctcctctctctgctcaagcagtccaacctgtctcagtaccacccccagatcctcaagaccactctcttcacctgtcgatggtggtggggctccgaccactgtgtcaaggacaagtggaacctctcccacctctaccccaccatgctcctcgtcgaggccttcaccgaggttctgcacctcatcgacggtggtgagctctcctctctgtttgacgagtctttcaagtgcaagatcggtctgtccatcttccaggccgttctccgaatcatcctcacccaggacaacgacggctcttggcgaggctaccgagagcagacctgttacgccattctcgccctcgtccaggcccgacacgtctgtttcttcacccacatggtcgaccgactccagtcctgtgtcgaccgaggtttctcttggctcaagtcttgctccttccactctcaggacctcacctggacctccaagaccgcttacgaggttggtttcgttgccgaggcctacaagctcgctgctctccagtccgcctctctcgaggtccccgctgccaccatcggccactccgtcacctctgctgtcccctcctccgatctcgagaagtacatgcgactcgtccgaaagaccgctctgttctctcccctcgatgagtggggtctgatggcctccatcatcgagtcctccttctttgtccccctcctccaggcccagcgagttgagatctacccccgagacaacatcaaggtcgacgaggacaagtacctctccatcatccccttcacctgggttggctgcaacaaccgatctcgaacctttgcctccaaccgatggctctacgacatgatgtacctgtctctgctcggctaccagaccgacgagtacatggaggccgttgccggccccgtctttggtgatgtctctctgctgcaccagaccatcgacaaggtcattgacaacaccatgggtaacctggcccgagccaacggtaccgtccactccggcaacggtcaccagcacgagtcccccaacattggccaggtcgaggacaccctcactcgatttaccaactccgtcctcaaccacaaggacgtcctcaactcctcctcctccgaccaggacaccctccgacgagagttccgaaccttcatgcacgcccacatcacccagatcgaggacaactcccgattctccaagcaggcttcttccgacgccttctcctcccccgagcagtcctacttccagtgggtcaactccactggtggttcccacgttgcctgcgcctactctttcgccttctccaactgcctcatgtccgccaacctcctccagggtaaggacgccttcccttccggtacccagaagtacctcatctcctccgtcatgcgacacgccaccaacatgtgccgaatgtacaacgatttcggttccatcgcccgagacaacgccgagcgaaacgtcaactccatccactttcccgagttcactctctgtaacggtacctcccagaacctcgacgagcgaaaggagcgactcctcaagattgctacttacgagcagggctacctcgaccgagctctcgaggctctggagcgacagtcccgagatgatgctggtgaccgagccggctccaaggacatgcgaaagctcaagattgtcaagctcttctgtgacgtcaccgacctctacgaccagctctacgtcatcaaggacctctcctcctccatgaaataactatccgaagatcaagagcgaagcaagttgtaagtccaggacatgtttcccgcccacgcg

SEQ ID NO: 185 - DNA, 1698 bp, Artificial sequence
  KAH4
ttgaatcttttttcttcttctcttctctatattcattcttgaattaaacacacatcaacaatggagtctctggttgtccacaccgtcaacgccatctggtgcattgtcattgtcggtatcttctccgtcggctaccacgtctacggccgagctgttgtcgagcagtggcgaatgcgacgatctctcaagctccagggtgtcaagggtcctcctccctccatcttcaacggtaacgtttccgagatgcagcgaatccagtccgaggccaagcactgctccggtgacaacatcatctcccacgactactcttcttctctgttcccccactttgaccactggcgaaagcagtacggccgaatctacacctactccactggcctcaagcagcacctctacatcaaccaccccgagatggtcaaggagctctcccagaccaacaccctcaacctcggccgaatcacccacatcaccaagcgactcaaccccattctcggtaacggtatcatcacctccaacggcccccactgggcccaccagcgacgaatcattgcctacgagttcacccacgacaagatcaagggtatggtcggtctgatggtcgagtccgccatgcccatgctcaacaagtgggaggagatggtcaagcgaggtggtgagatgggctgtgacatccgagtcgacgaggacctcaaggatgtctccgctgacgtcattgccaaggcctgtttcggctcttccttctccaagggcaaggccatcttctccatgatccgagatctgctcaccgccatcaccaagcgatccgtcctcttccgattcaacggtttcaccgacatggttttcggctccaagaagcacggtgacgttgacattgacgctctcgagatggagctcgagtcctccatctgggagactgtcaaggagcgagagattgagtgcaaggacacccacaagaaggacctcatgcagctcattctcgagggtgccatgcgatcttgtgacggtaacctgtgggacaagtctgcttaccgacgattcgttgtcgacaactgcaagtccatctactttgccggccacgactccaccgccgtttccgtttcttggtgcctcatgctgctcgctctcaacccctcttggcaggtcaagatccgagatgagattctgtcctcctgcaagaacggtatccccgacgccgagtccatccccaacctcaagaccgtcaccatggtcatccaggagactatgcgactctaccctcccgctcccattgtcggccgagaggcctccaaggacattcgactcggtgatctggttgtccccaagggtgtctgtatctggaccctcatccccgctctgcaccgagatcccgagatctggggtcccgacgccaacgacttcaagcccgagcgattctccgagggtatctccaaggcctgcaagtacccccagtcctacatcccctttggcctcggcccccgaacctgtgtcggcaagaactttggtatgatggaggtcaaggtcctcgtttctctgattgtctccaagttctccttcactctgtctcccacctaccagcactctccctcccacaagctgctcgtcgagccccagcacggtgttgtcatccgagttgtataaacttcgagctaatccagtagcttacgttacccaggggcaggtcaactggctagccacgag

SEQ ID NO: 186 - DNA, 1698 bp, Artificial sequence
  KOgib
cacacccgaaatcgttaagcatttccttctgagtataagaatcattcgctagccacaaaaatgtccaagtccaactccatgaactccacctcccacgagactctcttccagcagctcgttctcggcctcgaccgaatgcccctcatggacgtccactggctcatctacgttgcctttggtgcctggctctgctcctacgtcatccacgttctgtcctcttcctccactgtcaaggtccccgtcgtcggttaccgatccgttttcgagcccacctggctcctccgactgcgattcgtctgggagggtggttccatcattggccagggctacaacaagttcaaggactccatcttccaggtccgaaagctcggtaccgacattgtcatcatccctcccaactacattgacgaggtccgaaagctctcccaggacaagacccgatccgtcgagcccttcatcaacgactttgccggccagtacacccgaggtatggtctttctgcagtccgatctccagaaccgagtcatccagcagcgactcacccccaagcttgtctctctcaccaaggtcatgaaggaagagctcgactacgctctgaccaaggagatgcccgacatgaagaacgacgagtgggttgaggtcgacatctcttccatcatggtccgactcatctctcgaatctccgcccgagttttcctcggccccgagcactgccgaaaccaggagtggctcaccaccaccgccgagtactccgagtctctcttcatcaccggcttcatcctccgagttgtcccccacattctccgacccttcattgctcctctgctgccctcttaccgaaccctgctgcgaaacgtttcttccggccgacgagtcattggtgatatcatccgatcccagcagggtgacggtaacgaggacatcctctcttggatgcgagatgctgccactggtgaggagaagcagatcgacaacattgcccagcgaatgctcattctgtctctcgcctccatccacaccaccgccatgaccatgacccacgccatgtacgatctgtgtgcctgccccgagtacattgagcccctccgagatgaggtcaagtccgtcgttggtgcttctggctgggacaagaccgctctcaaccgattccacaagctcgactctttcctcaaggagtcccagcgattcaaccccgttttcctgctcaccttcaaccgaatctaccaccagtccatgaccctctccgatggtaccaacatcccctccggtacccgaattgctgtcccctctcacgccatgctccaggactccgcccacgtccccggtcccactcctcccactgagttcgacggtttccgatactccaagatccgatccgactccaactacgcccagaagtacctcttctccatgaccgactcttccaacatggcctttggctacggtaagtacgcctgccccggccgattctacgcctccaacgagatgaagctgactctggccattctgctcctccagtttgagttcaagctccccgacggtaagggccgaccccgaaacatcaccatcgactccgacatgatccccgacccccgagctcgactctgtgtccgaaagcgatctctgcgtgacgagtaagctatttacagcatgtgtaatgaggaatataacgttgattgaattgtttgtgaaaaatgt

SEQ ID NO: 187 - DNA, 2262 bp, Artificial sequence
  CPR1
cgtccatatatatctatgctgcgtcgtccttttcgtgacatcaccaaaacacatacaaaaatggctgagctcgacactctcgacattgttgttctcggtgtcatcttcctcggtaccgttgcctacttcaccaagggtaagctgtggggtgtcaccaaggacccctacgccaacggctttgctgctggtggtgcctccaagcccggccgaacccgaaacattgttgaggccatggaggagtccggcaagaactgtgttgttttctacggctcccagaccggcaccgccgaggactacgcctctcgactggccaaggaaggcaagtctcgattcggtctgaacaccatgatcgctgatctcgaggactacgactttgacaacctggacaccgtcccctccgacaacatcgtcatgtttgtcctggccacctacggtgagggtgagcccaccgacaacgccgtcgacttctacgagttcatcaccggtgaggacgcttctttcaacgagggtaacgaccctcctctcggcaacctcaactacgttgccttcggtctgggcaacaacacctacgagcactacaactccatggtccgaaacgtcaacaaggctctcgagaagctcggcgcccaccgaatcggtgaggctggtgagggtgacgacggtgccggtaccatggaggaagatttcctggcctggaaggaccccatgtgggaggctctcgccaagaagatgggcctcgaggagcgagaggccgtctacgagcccatctttgccatcaacgagcgagatgatctcacccccgaggccaacgaggtctacctcggtgagcccaacaagctccacctcgagggtaccgccaagggccccttcaactcccacaacccctacattgcccccattgctgagtcctacgagctgttctccgccaaggaccgaaactgtctgcacatggagattgacatctccggctccaacctcaagtacgagactggtgaccacatcgccatctggcccaccaaccccggtgaagaggtcaacaagttcctcgacatcctcgatctctccggcaagcagcactctgttgtcaccgtcaaggctctcgagcccaccgccaaggtccccttccccaaccccaccacctacgacgccatcctgcgataccacctcgagatctgtgcccccgtttctcgacagttcgtttccactctggctgcctttgcccccaacgacgacatcaaggccgagatgaaccgactcggctccgacaaggactacttccacgagaaaaccggtcctcactactacaacattgctcgattcctggcttctgtctccaagggtgagaagtggaccaagatccccttctccgccttcattgagggtctgaccaagctccagccccgatactactccatctcttcttcttctctcgtccagcccaagaagatctccatcaccgctgttgtcgagtcccagcagatccccggccgagatgaccccttccgaggtgttgccaccaactacctcttcgccctcaagcagaagcagaacggtgaccccaaccccgctcccttcggtcagtcttacgagctcaccggcccccgaaacaagtacgacggtatccacgtccccgtccacgtccgacactccaacttcaagctcccctccgaccccggcaagcccatcatcatgattggccccggtactggtgttgctcccttccgaggctttgtccaggagcgagccaagcaggctcgagatggtgtcgaggtcggtaagactctgctcttcttcggctgccgaaagtccaccgaggacttcatgtaccagaaggagtggcaggagtacaaagaggctctcggtgacaagttcgagatgatcaccgccttctcccgagagggctccaagaaggtctacgtccagcaccgactcaaggagcgatccaaggaagtctccgacctcctctcccagaaggcctacttctacgtctgcggtgacgccgcccacatggcccgagaggtcaacaccgttctggcccagatcattgccgagggccgaggtgtctccgaggccaagggcgaggagattgtcaagaacatgcgatctgccaaccagtaccaggtctgctccgactttgtcaccctccactgcaaggagactacttacgccaactccgagctccaggaagatgtctggtcttaaaattaacagatagtttgccggtgataattctcttaacctcccacactcctttgacataac

SEQ ID NO: 188 - DNA, 2256 bp, Artificial sequence
  CPR3
cgtccatatatatctatgctgcgtcgtccttttcgtgacatcaccaaaacacatacaaaaatgtcctcctcttcttcttcttccacctccatgattgatctcatggctgccatcatcaagggtgagcccgtcattgtctccgaccccgccaacgcctccgcctacgagtccgttgctgccgagctgtcctccatgctcatcgagaaccgacagtttgccatgatcgtcaccacctccattgctgttctcattggctgcattgtcatgctcgtctggcgacgatctggctccggtaactccaagcgagtcgagcccctcaagcccctggtcatcaagccccgagaagaggagatcgacgacggccgaaagaaggtcaccatcttctttggcacccagaccggtactgctgagggcttcgccaaggctctcggtgaggaagccaaggctcgatacgaaaagacccgattcaagattgtcgacctcgatgattacgctgccgatgacgacgagtacgaggagaagctcaagaaagaggacgttgccttcttcttcctcgccacctacggtgacggtgagcccaccgacaacgctgcccgattctacaagtggttcaccgagggtaacgaccgaggcgagtggctcaagaacctcaagtacggtgttttcggtctgggcaaccgacagtacgagcacttcaacaaggttgccaaggttgtcgacgacatcctcgtcgagcagggtgcccagcgactcgtccaggtcggcctcggtgatgatgaccagtgcatcgaggacgacttcactgcctggcgagaggctctgtggcccgagctcgacaccattctgcgagaggaaggtgacaccgccgttgccaccccctacaccgccgccgtcctcgagtaccgagtctccatccacgactccgaggatgccaagttcaacgacatcaacatggccaacggtaacggctacaccgtctttgacgcccagcacccctacaaggccaacgtcgccgtcaagcgagagctccacacccccgagtccgaccgatcttgtatccacctcgagtttgacattgctggttccggtctgacctacgagactggtgaccacgttggtgtcctctgtgacaacctgtccgagactgtcgacgaggctctgcgactcctcgacatgtcccccgacacttacttctctctgcacgccgagaaagaggacggtactcccatctcttcttctctgccccctcccttccctccctgcaacctgcgaaccgctctgacccgatacgcctgcctcctctcttctcccaagaagtctgctctcgttgctctggccgcccacgcctccgaccccaccgaggctgagcgactcaagcacctcgcctctcccgctggcaaggacgagtactccaagtgggttgtcgagtcccagcgatctctgctcgaggtcatggccgagttcccctccgccaagccccctctcggtgttttcttcgccggtgttgctccccgactccagccccgattctactccatctcctcttcccccaagatcgccgagactcgaatccacgttacctgtgctctggtctacgagaagatgcccaccggccgaatccacaagggtgtctgctccacctggatgaagaacgccgttccctacgagaagtccgagaactgttcctctgctcccatctttgtccgacagtccaacttcaagctcccctccgactccaaggtccccatcatcatgattggccccggtaccggcctcgcccccttccgaggcttcctgcaggagcgactcgccctcgtcgagtccggtgtcgagctcggcccctccgtcctcttctttggctgccgaaaccgacgaatggacttcatctacgaagaggagctccagcgattcgtcgagtccggtgctctcgccgagctctccgttgccttctcccgagagggtcccaccaaggagtacgtccagcacaagatgatggacaaggcctccgacatctggaacatgatctcccagggcgcctacctctacgtctgcggtgacgccaagggtatggcccgagatgtccaccgatctctgcacaccattgcccaggagcagggctccatggactccaccaaggccgagggtttcgtcaagaacctccagacctccggccgatacctccgagatgtctggtaaaattaacagatagtttgccggtgataattctcttaacctcccacactcctttgacataac

SEQ ID NO: 189 - DNA, 1566 bp, Artificial sequence
  UGT1
cccactagttataaagtcacaagtatctcagtatacccgtctaaccacacatttatcaccatggacgccatggccaccaccgagaagaagccccacgtcatcttcatccccttccccgcccagtcccacatcaaggccatgctcaagctcgcccagctcctccaccacaagggcctccagatcacctttgtcaacaccgacttcatccacaaccagttcctcgagtcctccggcccccactgtctggacggtgctcccggtttccgatttgagactatccccgatggtgtctcccactcccccgaggcctccatccccatccgagagtctctgctccgatccattgagactaacttcctcgaccgattcattgatctcgtcaccaagctccccgatcctcccacctgtatcatctccgacggtttcctgtccgttttcaccattgatgctgccaagaagctcggtatccccgtcatgatgtactggactctggctgcctgtggtttcatgggtttctaccacatccactctctgatcgagaagggctttgctcctctcaaggacgcctcctacctcaccaacggttacctcgacaccgtcattgactgggtccccggtatggagggtatccgactcaaggacttccccctcgactggtccaccgacctcaacgacaaggttctcatgttcaccaccgaggctccccagcgatcccacaaggtttcccaccacatcttccacaccttcgacgagctcgagccctccatcatcaagactctgtctctgcgatacaaccacatctacaccattggccccctccagctcctcctcgaccagatccccgaggagaagaagcagaccggtatcacctctctgcacggctactctctcgtcaaggaagagcccgagtgcttccagtggctccagtccaaggagcccaactccgttgtctacgtcaactttggctccaccaccgtcatgtctctcgaggacatgaccgagtttggctggggtctggccaactccaaccactacttcctgtggatcatccgatccaacctcgtcattggcgagaacgccgttctgcctcccgagctcgaggagcacatcaagaagcgaggcttcattgcctcttggtgctcccaggagaaggttctcaagcacccctccgtcggtggtttcctgacccactgcggctggggctccaccattgagtctctgtccgctggtgtccccatgatctgctggccctactcctgggaccagctcaccaactgccgatacatctgcaaggagtgggaggttggtctggagatgggtaccaaggtcaagcgagatgaggtcaagcgactcgtccaggagctcatgggcgagggtggtcacaagatgcgaaacaaggccaaggactggaaggagaaggcccgaattgccattgcccccaacggctcttcttctctcaacattgacaagatggtcaaggagatcactgttctcgctcgaaactaactatccgaagatcaagagcgaagcaagttgtaagtccaggacatgtttcccgcccacgcg

SEQ ID NO: 190 - DNA, 1503 bp, Artificial sequence
  UGT3
ttgaatcttttttcttcttctcttctctatattcattcttgaattaaacacacatcaacaatggccgagcagcagaagatcaagaagtctccccacgttctgctcatccccttccctctgcagggccacatcaaccccttcatccagttcggcaagcgactcatctccaagggtgtcaagaccactctggtcaccaccatccacaccctcaactccactctcaaccactccaacaccaccaccacctccatcgagatccaggccatctccgacggctgtgacgagggtggtttcatgtctgctggtgagtcttacctcgagactttcaagcaggtcggttccaagtctctggctgacctcatcaagaagctccagtccgagggtaccaccattgacgccatcatctacgactccatgaccgagtgggttctcgatgtcgccatcgagtttggtattgacggtggctccttcttcacccaggcctgtgtcgtcaactctctctactaccacgtccacaagggtctgatctctctgcccctcggcgagactgtctccgtccccggtttccccgttctgcagcgatgggagactcctctcattctccagaaccacgagcagatccagtccccctggtcccagatgctcttcggccagttcgccaacattgaccaggcccgatgggttttcaccaactccttctacaagctcgaggaagaggtcattgagtggacccgaaagatctggaacctcaaggtcattggccccaccctcccctccatgtacctcgacaagcgactcgatgacgacaaggacaacggtttcaacctctacaaggccaaccaccacgagtgcatgaactggctcgacgacaagcccaaggagtccgttgtctacgttgcctttggctctctggtcaagcacggccccgagcaggttgaggagatcacccgagctctgattgactccgatgtcaacttcctgtgggtcatcaagcacaaggaagagggtaagctccccgagaacctgtccgaggtcatcaagaccggcaagggcctcattgttgcctggtgcaagcagctcgacgttctcgcccacgagtccgtcggctgctttgtcacccactgcggtttcaactccaccctcgaggctatctctctcggtgtccccgttgttgccatgccccagttctccgaccagaccaccaacgccaagctcctcgatgagattctcggtgtcggtgtccgagtcaaggctgacgagaacggtattgtccgacgaggtaacctggcttcttgtatcaagatgatcatggaggaagagcgaggtgtcatcatccgaaagaacgccgtcaagtggaaggatctggccaaggttgctgtccacgagggtggctcttccgacaacgacattgtcgagtttgtctccgagctcatcaaggcctaaacttcgagctaatccagtagcttacgttacccaggggcaggtcaactggctagccacgag

SEQ ID NO: 191 - DNA, 1497 bp, Artificial sequence
  UGT4
cacacccgaaatcgttaagcatttccttctgagtataagaatcattcgctagccacaaaaatggagaacaagaccgagactaccgtccgacgacgacgacgaatcattctcttccccgtccccttccagggccacatcaaccccattctgcagctcgccaacgttctgtactccaagggcttctccatcaccatcttccacaccaacttcaacaagcccaagacctccaactacccccacttcactttccgattcatcctcgacaacgacccccaggacgagcgaatctccaacctgcccacccacggtcctctggctggtatgcgaatccccatcatcaacgagcacggtgctgacgagctccgacgagagctcgagctgctcatgctcgcctccgaagaggacgaggaagtctcctgtctgatcaccgatgctctgtggtactttgcccagtccgtcgccgactctctcaacctgcgacgactcgttctcatgacctcctctctgttcaacttccacgcccacgtttctctgccccagtttgacgagctcggttacctcgaccccgatgacaagacccgactcgaggagcaggcttccggtttccccatgctcaaggtcaaggacatcaagtccgcctactccaactggcagattctcaaggagattctcggcaagatgatcaagcagaccaaggcctcctccggtgtcatctggaactccttcaaggagctcgaggagtccgagctcgagactgtcatccgagagatccccgctccctctttcctcatccccctgcccaagcacctcaccgcttcctcctcttctctgctcgaccacgaccgaaccgtctttcagtggctcgaccagcagcccccttcctccgtcctctacgtttccttcggctccacctccgaggtcgacgagaaggacttcctcgagattgctcgaggcctcgttgactccaagcagtccttcctgtgggttgtccgacccggctttgtcaagggctccacctgggttgagcccctgcccgatggtttcctcggtgagcgaggccgaattgtcaagtgggtcccccagcaggaagttctggcccacggtgccattggtgccttctggacccactccggctggaactccactctcgagtccgtctgcgagggtgtccccatgatcttctccgactttggcctcgaccagcccctcaacgcccgatacatgtccgatgttctcaaggtcggtgtctacctcgagaacggctgggagcgaggtgagattgccaacgccatccgacgagtcatggtcgacgaggaaggtgagtacatccgacagaacgcccgagtcctcaagcagaaggccgatgtctctctcatgaagggtggttcttcttacgagtctctcgagtctctcgtttcctacatctcttctttgtaagctatttacagcatgtgtaatgaggaatataacgttgattgaattgtttgtgaaaaatgt

SEQ ID NO: 192 - DNA, 1542 bp, Artificial sequence
  UGT9
cgtccatatatatctatgctgcgtcgtccttttcgtgacatcaccaaaacacatacaaaaatggccacctccgactccattgtcgacgaccgaaagcagctgcacgttgccaccttcccctggctcgcctttggccacattctgccctacctccagctctccaagctcattgctgagaagggccacaaggtttctttcctgtccaccacccgaaacatccagcgactctcctcccacatctctcctctcatcaacgttgtccagctcaccctcccccgagtccaggagctccccgaggatgccgaggccaccactgatgtccaccccgaggacatcccctacctcaagaaggcctccgacggtctgcagcccgaggtcacccgattcctcgagcagcactctcccgactggatcatctacgactacacccactactggctcccctccattgctgcttctctcggtatctctcgagcccacttctccgtcaccaccccctgggccattgcttacatgggcccctctgctgacgccatgatcaacggttccgacggccgaaccaccgtcgaggatctcaccacccctcccaagtggttccccttccccaccaaggtctgctggcgaaagcacgatctcgcccgactcgtcccctacaaggcccccggtatctccgacggttaccgaatgggtctggttctcaagggctccgactgtctgctctccaagtgctaccacgagtttggtacccagtggctccccctgctcgagactctgcaccaggtccccgttgtccccgtcggtctgctccctcccgagatccccggtgacgagaaggacgagacttgggtttccatcaagaagtggctcgacggcaagcagaagggctccgtcgtctacgttgctctcggctccgaggttcttgtctcccagactgaggtcgtcgagctcgccctcggtctggagctctccggtctgcccttcgtctgggcctaccgaaagcccaagggtcccgccaagtccgactccgtcgagctccccgacggtttcgtcgagcgaactcgagatcgaggtctggtctggacctcttgggctccccagctccgaatcctctcccacgagtccgtctgcggtttcctgacccactgtggttccggctccattgtcgagggcctcatgttcggccaccccctcatcatgctgcccatcttcggtgaccagcccctcaacgcccgactcctcgaggacaagcaggtcggtatcgagatcccccgaaacgaagaggacggctgcctcaccaaggagtctgttgcccgatctctgcgatctgttgttgtcgagaaagagggtgagatctacaaggccaacgcccgagagctctccaagatctacaacgacaccaaggtcgagaaggagtacgtttcccagtttgtcgactacctcgagaagaacgcccgagctgtcgccattgaccacgagagttaaaattaacagatagtttgccggtgataattctcttaacctcccacactcctttgacataac

SEQ ID NO: 193 - DNA, 880 bp, Artificial sequence
  pTPI
aaacaaaagagctgaaatcatatccttcagtagtagtatagtcctgttatcacagcatcaattacccccgtccaagtaagttgattgggatttttgtttacagatacagtaatatacttgactatttctttacaggtgactcagaaagtgcatgttggaaatgagccacagaccaagacaagatatgacaaaattgcactattcgatgcagaattcgacggtgtttccattggtgttatgacattcatctgcattcatacaaaaaagtcttggtagtggtacttttgcgttattacctccgatatctacgcaccccccaacccccctgctacagtaaagagtgtgagtctactgtacatgcttactaaaccacctactgtacagcgaaacccctcagcaaaatcacacaatcagctcattacaacacacccaatgacctcaccacaaattctatacgccttttgacgccattattacagtagcttgcaacgccgttgtcttaggttccatttttagtgctctattacctcacttaacccgtataggcagatcaggccatggcactaagtgtagagctagaggttgatatcgccacgagtgctccatcagggctagggtggggttagaaatacagtccgtgcgcactcaaaaggcgtccgggttagggcatccgataatatcgcctggactcggcgccatattctcgacttctgggcgcgttgtattcatctcctccgcttcccaacacttccacccgtttctccatcccaaccaatagaatagggtaaccttattcgggacactttcgtcatacatagtcagatatacaagcaatgtcactctccttcgtactcgtacatacaacacaactacattcaaa

SEQ ID NO: 194 - DNA, 1183 bp, Artificial sequence
  gpdT-pGPD
ctatccgaagatcaagagcgaagcaagttgtaagtccaggacatgtttcccgcccacgcgagtgatttataacacctctcttttttgacacccgctcgccttgaaattcatgtcacataaattatagtcaacgacgtttgaataacttgtcttgtagttcgatgatgatcatatgattacattaatagtaattactgtatggcgcgccggtagtcggaaagagccgggaccggccggcgagcataaaccggacgcagtaggatgtcctgcacgggtctttttgtggggtgtggagaaaggggtgcttggagatggaagccggtagaaccgggctgcttggggggatttggggccgctgggctccaaagaggggtaggcatttcgttggggttacgtaattgcggcatttgggtcctgcgcgcatgtcccattggtcagaattagtccggataggagacttatcagccaatcacagcgccggatccacctgtaggttgggttgggtgggagcacccctccacagagtagagtcaaacagcagcagcaacatgatagttgggggtgtgcgtgttaaaggaaaaaaaaagaagcttgggttatattcccgctctatttagaggttgcgggatagacgccgacggagggcaatggcgccatggaaccttgcggatatcgatacgccgcggcggactgcgtccgaaccagctccagcagcgttttttccgggccattgagccgactgcgaccccgccaacgtgtcttggcccacgcactcatgtcatgttggtgttgggaggccactttttaagtagcacaaggcacctagctcgcagcaaggtgtccgaaccaaagaagcggctgcagtggtgcaaacggggcggaaacggcgggaaaaagccacgggggcacgaattgaggcacgccctcgaatttgagacgagtcacggccccattcgcccgcgcaatggctcgccaacgcccggtcttttgcaccacatcaggttaccccaagccaaacctttgtgttaaaaagcttaacatattataccgaacgtaggtttgggcgggcttgctccgtctgtccaaggcaacatttatataagggtctgcatcgccggctcaattgaatcttttttcttcttctcttctctatattcattcttgaattaaacacacatcaaca

SEQ ID NO: 195 - DNA, 639 bp, Artificial sequence
  pgmT-pTEF
acttcgagctaatccagtagcttacgttacccaggggcaggtcaactggctagccacgagtctgtcccaggtcgcaatttagtgtaataaacaatatatatattgagtctaaagggaattgtagctattgtgattgtgtgattttcgtcttgctggttcttattgtgtcccattcgtttcatcctgatgaggacccctggcgtacgccggcgaagcttggtaccagagacgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcgctagccacaaaa

SEQ ID NO: 196 - DNA, 1009 bp, Artificial sequence
  pgkT-pPGM
gctatttacagcatgtgtaatgaggaatataacgttgattgaattgtttgtgaaaaatgtagaaaatttcagtgaagttgtgttttctatatagtaagcacttttggtacaagtatctgcacatccctgcatgttacaagcctgatcatgcagggcaatattctgactataaatatacctcgatattttagcaagctatacgtacgtaccaaccacagattacgacccattcgcagtcacagttcactagggtttgggttgcatccgttgagagtggtttgtttttaaccttctccatgtgctcactcaggttttgggttcagatcaaatcaaggcgtgaaccactgtttgaggacaaatgtgacacaaccaaccagtgtcaggggcaagtccgtgacaaaggggaagatacaatgcaattactgacagttacggactgcctcgatgccctaaccttgccccaaaataagacaactgtcctcgtttaagcgcaaccctattcagcgtcacgtcataatagcgtttggatagcactagtctatgaggagcgttttatgttgcggtgagggcgattggtgctcatatgggttcaattgaggtggtggaacgagcttagtcttcaattgaggtgcgagcgacacaattgggtgtcacgtggcctaattgacctcggatcgtggagtccccagttatacagcaaccacgaggtgcatgagtaggagacgtcaccagacaatagggtttttttggactggagagggtagggcaaaagcgctcaacgggctgtttggggagctatgggggaggaattggcgatatttgtgaggttgacggctccgatttgcgtgttttgtcgcttctgcatctccccatacccatatcttccctccccacctctttccacgataattttacggatcagcaataaggttccttctcctagtttccacgtccatatatatctatgctgcgtcgtccttttcgtgacatcaccaaaacacatacaaaa

SEQ ID NO: 197 - DNA, 2472 bp, Artificial sequence
  LEU2 and flanking sequences
aaaattaacagatagtttgccggtgataattctcttaacctcccacactcctttgacataacgatttatgtaacgaaactgaaatttgaccagatattgttgtaaatagaaaatctggcttgtaggtggaaactagtaacggccgccagtgtgctggaattcggctccactgtcctccactacaaacacacccaatctgcttcttctagtcaaggttgctacaccggtaaattataaatcatcatttcattagcagggctgggccctttttatagagtcttatacactagcggaccctgccggtagaccaacccgcaggcgcgtcagtttgctccttccatcaatgcgtcgtagaaacgacttactccttcttgagcagctccttgaccttgttggcaacaaagtctccgacctcggaggtggaggaagagcctccgatatcggcggtagtgataccagcctcgacggactccttgacggcagcctcaacagcgtcaccggcgggcttcatgttaagagagaacttgagcatcatggcggcagacagaatggtggcaatggggttgaccttctgcttgccgagatcgggggcagatccgtgacagggctcgtacagaccgaacgcctcgttggtgtcgggcagagaagccagagaggcggagggcagcagacccagagaaccggggatgacggaggcctcgtcggagatgatatcgccaaacatgttggtggtgatgatgataccattcatcttggagggctgcttgatgaggatcatggcggccgagtcgatcagctggtggttgagctcgagctgggggaattcgtccttgaggactcgagtgacagtctttcgccaaagtcgagaggaggccagcacgttggccttgtcaagagaccacacgggaagaggggggttgtgctgaagggccaggaaggcggccattcgggcaattcgctcaacctcaggaacggagtaggtctcggtgtcggaagcgacgccagatccgtcatcctcctttcgctctccaaagtagatacctccgacgagctctcggacaatgatgaagtcggtgccctcaacgtttcggatgggggagagatcggcgagcttgggcgacagcagctggcagggtcgcaggttggcgtacaggttcaggtcctttcgcagcttgaggagaccctgctcgggtcgcacgtcggttcgtccgtcgggagtggtccatacggtgttggcagcgcctccgacagcaccgagcataatagagtcagcctttcggcagatgtcgagagtagcgtcggtgatgggctcgccctccttctcaatggcagctcctccaatgagtcggtcctcaaacacaaactcggtgccggaggcctcagcaacagacttgagcaccttgacggcctcggcaatcacctcggggccacagaagtcgccgccgagaagaacaatcttcttggagtcagtcttggtcttcttagtttcgggttccattgtggatgtgtgtggttgtatgtgtgatgtggtgtgtggagtgaaaatctgtggctggcaaacgctcttgtatatatacgcacttttgcccgtgctatgtggaagactaaacctccgaagattgtgactcaggtagtgcggtatcggctagggacccaaaccttgtcgatgccgatagcgctatcgaacgtaccccagccggccgggagtatgtcggaggggacatacgagatcgtcaagggtttgtggccaactggtaaataaatgatgactcaggcgacgacggaattcgacagcaactactcctttcaccaaccatgtgcattttagctcgaataacattcacaggcttggtgatctacatccatggtgtctggccgattaccgtggtgttttggcagtaacgagaatattgagtggactcttcccatcaccaataaagactcatactacaatcacgagcgcttcagctgccactatagtgttggtgacacaatacccctcgatgctgggcattactgtagcaagagatattatttcatggcgcatttttccagtctacctgactttttagtgtgatttcttctccacattttatgctcagtgtgaaaagttggagtgcacacttaattatcgccggttttcggaaagtactatgtgctcaaggttgcaccccacgttacgtatgcagcacattgagcagcctttggaccgtggagataacggtgtggagatagcaacgggtagtcttcgtaataagcaatgcagccgaattctgcagatatccatcacactggcggccgctcgagcatgcatctagatggcctccttggccgggtttcaattcaattcatcattttttttttattcttttttttgatttcggtttctttgaaatttttttgattcggtaatctccgaacagaaggaagaacgaaggaaggagcacagacttagattggtatatatacgca

SEQ ID NO: 198 - DNA, 6989 bp, Artificial sequence
  Vector sequences
ctagatggcctccttggccgggtttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttttataatgacgaaaaaaaaaaaattggaaagaaaaccccccccccgcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaattcccccttacacggaggcatcaagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcaggtgggccattctcatgaagaatatcttgaatttattgtcatattactagttggtgtggaagtccatatatcggtgatcaatatagtggttgacatgctggctagtcaacattgagccttttgatcatgcaaatatattacggtattttacaatcaaatatcaaacttaactattgactttataacttatttaggtggtaacattcttataaaaaagaaaaaaattactgcaaaacagtactagcttttaacttgtatcctaggttatctatgctgtctcaccatagagaatattacctatttcagaatgtatgtccatgattcgccgggtaaatacatataatacacaaatctggcttaataaagtctataatatatctcataaagaagtgctaaattggctagtgctatatatttttaagaaaatttcttttgactaagtccatatcgactttgtaaaagttcactttagcatacatatattacacgagccagaaattgtaacttttgcctaaaatcacaaattgcaaaatttaattgcttgcaaaaggtcacatgcttataatcaacttttttaaaaatttaaaatacttttttattttttatttttaaacataaatgaaataatttatttattgtttatgattaccgaaacataaaacctgctcaagaaaaagaaactgttttgtccttggaaaaaaagcactacctaggagcggccaaaatgccgaggctttcatagcttaaactctttacagaaaataggcattatagatcagttcgagttttcttattcttccttccggttttatcgtcacagttttacagtaaataagtatcacctcttagagttaactatgagataagcaagtatcatctcatttcatttacctgaagtcgagtaaacagaaaatccaattgttgatgaacctcaatgacttagaactatctatcggcagatcatataaagaggatttaggtacctagaggactgtacctggagtatatatatatatatatatatattatctcaactatagtccatagaggtttctttcttgaggccttaaactgctaaagaatgatattggtggaatgcaagcaccaatctctcttctttcgtaactgttcatatacttcaaaccaagaatgtaacgggcattgacccatccaaaaccttcagtagctgcccctttaaagtcagcaccttgattaccgtattctgcttcaacacgatgaggatctgttcctcttgtgacatcatatttttcaaccacaataccattataatcgacaaaagcctttgtcatcatgaaaagccatctataagctagcctattcgttacagttaaataaccataagaacggaggccttcccaagcaagaatttgatggggtgcccaaccaaatggatagtcccattgtctaattggtctcgaaatagaaattgggcctcgagaacgctccgtacatgcagctaaacctccaagcatctctaacttgggtagtgctttctccaccattttctgtgcttgctccttcgtggcaagtccagcccataatgcccagaatgtagttgcggattcgtatgacgttctgtgcttgatttttgtgttgtagtcaaagaaaaaccccgactcgtcatcccacatatatttggtaattgatgaggcaacgctaattatcaacatatagattgttatctatctgcatgaacacgaaatctttacttgacgacttgaggctgatggtgtttatgcaaagaaaccactgtgtttaatatgtgtcactgtttgatattactgtcagcgtagaagataatagtaaaagcggttaataagtgtatttgagataagtgtgataaagtttttacagcgaaaagacgataaatacaagaaaatgattacgaggatacggagagaggtatgtacatgtgtatttatatactaagctgccggcggttgtttgcaagaccgagaaaaggctagcaagaatcgggtcattgtagcgtatgcgcctgtgaacattctcttcaacaagtttgattccattgcggtgaaatggtaaaagtcaaccccctgcgatgtatattttcctgtacaatcaatcaaaaagccaaatgatttagcattatctttacatcttgttattttacagattttatgtttagatcttttatgcttgcttttcaaaaggcctgcaggcaagtgcacaaacaatacttaaataaatactactcagtaataacctatttcttagcatttttgacgaaatttgctattttgttagagtcttttacaccatttgtctccacacctccgcttacatcaacaccaataacgccatttaatctaagcgcatcaccaacattttctggcgtcagtccaccagctaacataaaatgtaagctctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggtttccgcgcacatttccccgaaaagtgccacctgacgtctaagaaaccattattatcatgacattaacctataaaaataggcgtatcacgaggccctttcgtcttggccacctaggccggccttcccggaagtatatactaattcattccttgaatatttatgaaaagcaacatgtgtatttcttgtgtgtgcggcaaacgtagcaattgcaactgcataaacgatgattgtaaaagtatcacactttgctcagacaggttagattcacctggtacgagggcagtgtcttaaaggttccatctacctcggcccttgtttcttgaagagtggtcaatatgtgttttatacagctgaaatttcccctgtatgttgagatcgtgtatattggtcataatctgggctctttagtcgatcccagttttctcgggcaagtttttttctccacaaagtaccgctggaaaactctatgtgacttgttgacagattacttgggttatctgcgggatatgtcttggataggcaaccgggcatatatcaccgggcggactgttggttctgtac

SEQ ID NO: 199 - DNA, 1170 bp, Artificial sequence
  pENO
tcgggcaagtttttttctccacaaagtaccgctggaaaactctatgtgacttgttgacagattacttgggttatctgcgggatatgtcttggataggcaaccgggcatatatcaccgggcggactgttggttctgtacgtacatacagcactttgagctcatgtctcacacgcaaccatggtgcgtggaggctttggcatcctttctacttgtagtggctatagtacttgcagtccaagcaaacatgagtatgtgcttgtatgtactgaaacccgtctacggtaatattttagagtgtggaactatgggatgagtgctcattcgatactatgttgtcacccgatttgccgtttgcgaggtaagacacattcggtggttcaggcggctacttgtatgtagcatccacgttcatgttttgtggatcagattaatggtatggatatgcacggggcgtttccccggtaacgtgtaggcagtccagtgcaacccagacagctgagctctctatagccgtgcgtgtgcggtcatatcacgctacacttagctacagaataaagctcggtagcgccaacagcgttgacaaatagctcaagggcgtggagcacagggtttaggaggttttaatgggcgagaaggcgcgtagatgtagtcttcctcggtcccatcggtaatcacgtgtgtgccgatttgcaagacgaaaagccacgagaataaaccgggagaggggatggaagtccccgaacagcaaccagcccttgccctcgtggacataacctttcacttgccagaactctaagcgtcaccacggtatacaagcgcacgtagaagattgtggaagtcgtgttggagactgttgatttgggcggtggaggggggtatttgagagcaagtttgagatttgtgccattgagggggaggttattgtggccatgcagtcggatttgccgtcacgggaccgcaacatgcttttcattgcagtccttcaactatccatctcacctcccccaatggcttttaactttcgaatgacgaaagcacccccctttgtacagatgactatttgggaccaatccaatagcgcaattgggtttgcatcatgtataaaaggagcaatcccccactagttataaagtcacaagtatctcagtatacccgtctaaccacacattt

SEQ ID NO: 200 - DNA, 2276 bp, Artificial sequence
  HPH
aaattaacagatagtttgccggtgataattctcttaacctcccacactcctttgacataacgatttatgtaacgaaactgaaatttgaccagatattgttgtaaatagaaaatctggcttgtaggtggcaaactagtaacggccgccagtgtgctggaattgaatatttaccgttcgtataatgtatgctatacgaagttataccggtctcgtagtgttcacgttcagttcacggtgagcttaaaactatcttcaagaagagatttgagacctgatttatacttgcagcaatgtttacttcttatcgcgatacacgaatgtgatacggatcaaagtaagcaggactacgataagataacgaatgcggtgcagtccatgtcgattaggtatagatacatttattttgtgttatgttacattttggggggatactgtcctacttgtagtacctacttgtagtggcgcgtctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatgggtacctgagaacatttttgtgtctaggtgtttgtgtttggactgcgatcagtgaagaaaagaagaggaaaaattgtgcaagaaattttgctttcaagacttggctgatgcagcagggtaactctgggacacagacctatgtttgtggttaaactcaatgcacgtggtacgtgcgtggagcgcttacccatccaagggtgtggacatggaaccgacggtccgtggagttgtgtaatgtcattttggcgactcttgaagcaaggctataaaaaaattgtgtggcttgagtcttatcgagctcggtcactacaagagttaatcttcctgtctcaggcagacaggtcaggcagggttacttttgggtgtgctgtaactcactgtatggccgttagtgcgcatagacgttgtacatactggaccgaattgtagcgtgctcaatagggccaataaagctattgtagggatccataacttcgtataatgtatgctatacgaacggtacccgggcaattctgcagatatccatcacactggcggccgctcgagcatgcatctagatggcctccttggccgggtttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgca

SEQ ID NO: 201 - DNA, 600 bp, Artificial sequence
  Sc Eno2.promoter
gtgtcgacgctgcgggtatagaaagggttctttactctatagtacctcctcgctcagcatctgcttcttcccaaagatgaacgcggcgttatgtcactaacgacgtgcaccaacttgcggaaagtggaatcccgttccaaaactggcatccactaattgatacatctacacaccgcacgccttttttctgaagcccactttcgtggactttgccatatgcaaaattcatgaagtgtgataccaagtcagcatacacctcactagggtagtttctttggttgtattgatcatttggttcatcgtggttcattaattttttttctccattgctttctggctttgatcttactatcatttggatttttgtcgaaggttgtagaattgtatgtgacaagtggcaccaagcatatataaaaaaaaaaagcattatcttcctaccagagttgattgttaaaaacgtatttatagcaaacgcaattgtaattaattcttattttgtatcttttcttcccttgtctcaatcttttatttttattttatttttcttttcttagtttctttcataacaccaagcaactaatactataacatacaataata

SEQ ID NO: 202 - DNA, 600 bp, Artificial sequence
  Sc Fba1.promoter
ctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaa

SEQ ID NO: 203 - DNA, 600 bp, Artificial sequence
  Sc Tef1.promoter
ttggctgataatagcgtataaacaatgcatactttgtacgttcaaaatacaatgcagtagatatatttatgcatattacatataatacatatcacataggaagcaacaggcgcgttggacttttaattttcgaggaccgcgaatccttacatcacacccaatcccccacaagtgatcccccacacaccatagcttcaaaatgtttctactccttttttactcttccagattttctcggactccgcgcatcgccgtaccacttcaaaacacccaagcacagcatactaaatttcccctctttcttcctctagggtgtcgttaattacccgtactaaaggtttggaaaagaaaaaagacaccgcctcgtttctttttcttcgtcgaaaaaggcaataaaaatttttatcacgtttctttttcttgaaaatttttttttttgatttttttctctttcgatgacctcccattgatatttaagttaataaacggtcttcaatttctcaagtttcagtttcatttttcttgttctattacaactttttttacttcttgctcattagaaagaaagcatagcaatctaatctaagttttaattacaaa

SEQ ID NO: 204 - DNA, 600 bp, Artificial Sequence
  Sc Pgk1.promoter
gggccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaaca

SEQ ID NO: 205 - DNA, 1001 bp, Artificial sequence
  Kl prom 12.pro
cgtaaaaactaaaacgagcccccaccaaagaacaaaaaagaaggtgctgggcccccactttcttcccttgcacgtgataggaagatggctacagaaacaagaagatggaaatcgaaggaaagagggagactggaagctgtaaaaactgaaatgaaaaaaaaaaaaaaaaaaaaaaaacaagaagctgaaaatggaagactgaaatttgaaaaatggtaaaaaaaaaaaagaaacacgaagctaaaaacctggattccattttgagaagaagcaagaaaggtaagtatggtaacgaccgtacaggcaagcgcgaaggcaaatggaaaagctggagtccggaagataatcatttcatcttcttttgttagaacagaacagtggatgtccctcatctcggtaacgtattgtccatgccctagaactctctgtccctaaaaagaggacaaaaacccaatggtttccccagcttccagtggagccaccgatcccactggaaaccactggacaggaagagaaaatcacggacttcctctattgaaggataattcaacactttcaccagatcccaaatgtcccgcccctattcccgtgttccatcacgtaccataacttaccatttcatcacgttctctatggcacactggtactgcttcgactgctttgcttcatcttctctatgggccaatgagctaatgagcacaatgtgctgcgaaataaagggatatctaatttatattattacattataatatgtactagtgtggttattggtaattgtacttaattttgatatataaagggtggatctttttcattttgaatcagaattggaattgcaacttgtctcttgtcactattacttaatagtaattatatttcttattaaccttttttttaagtcaaaacaccaaggacaagaactactcttcaaaggtatttcaagttatcatacgtgtcacacacgcttcacagtttcaagtaaaaaaaaagaatattacaca

SEQ ID NO: 206 - DNA, 403 bp, Artificial sequence
  Ag lox_TEF1.promoter
taccgttcgtataatgtatgctatacgaagttatgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaca

SEQ ID NO: 207 - DNA, 1000 bp, Artificial sequence
  Kl prom 6.pro
caaagggggggcagggacagggatacgacaagggctggggaaaaaaaaaaagatagatacgattggccgggtaagcctggggaaatgtagcaagtgcgggtaagttaaaaggtaaccacgtgactccggaagagtcacgtggttacggacttttttctctagatctcagctttttatcggtcttaccctgccctcctgccccctgccccttccctttgccccaaaaagaaaggaaatctgttggatttcgctcaggccatccctttcgttaatatcggttatcgctttacacactgcacatccttctgtccaaaaggaatccagaagtttagcttttccttcctttcccacagacattagcctaggccctctctcatcatttgcatgcctcagccaatgtaccaagaataacgcaacgaggttgggaaattttaacccaacaatcgatgcagatgtgacaagagattagacacgttccagataccagattacacagcttgtgctagcagagtgacatatggtggtgttgtgtctcgtttagtacctgtaatcgagagtgttcaaatcagtcgatttgaacacccttactgccactgaatattgattgaataccgtttattgaaggttttatgagtgatcttctttcggtccaggacaatttgttgagctttttctatgtagagttccgtcccttttttttttttttttgctttctcgcacttactagcactatttttttttcacacactaaaacactttattttaatctatatatatatatatatatatatgtaggaatggaatcacagacatttgatactcatcctcatccttattaattcttgttttaatttgtttgacttagccaaaccaccaatctcaacccatcgtatttcaggtattgtgtgtctagtgtgtctctggtatacggaaataagtgccagaagtaaggaagaaacaaagaacaagtgtctgaatactactagcctctcttttcata

SEQ ID NO: 208 - DNA, 600 bp, Artificial sequence
  Sc Pma1.pro
ccatcatgaaaaatctctcgacaccgtttatccattgcttttttgttgtctttttccctcgttcacagaaagtctgaagaagctatagtagaactatgagctttttttgtttctgttttccttttttttttttttacctctgtggaaattgttactctcacactctttagttcgtttgtttgttttgtttattccaattatgaccggtgacgaaacgtggtcgatggtgggtaccgcttatgctcccctccattagtttcgattatataaaaaggccaaatattgtattattttcaaatgtcctatcattatcgtctaacatctaatttctcttaaattttttctctttctttcctataacaccaatagtgaaaatctttttttcttctatatctacaaaaactttttttttctatcaacctcgttgataaattttttctttaacaatcgttaataattaattaattggaaaataaccattttttctctcttttatacacacattcaaaagaaagaaaaaaaatataccccagctagttaaagaaaatcattgaaaagaataagaagataagaaagatttaattatcaaacaatatcaaa

SEQ ID NO: 209 - DNA, 600 bp, Artificial sequence
  Sc Vps68.promoter
gatatagccgctacgactgattagtgatgtgataaagatagaagatttaagtcacagaggcgtgcatctacgattttggcgtttcacattttttacacttaaattttagtgatctagccgtgaccttggcagcagtttccaaaatcattccatgaccatgtcatgcttaagaacgttagacccagaacaagtggacctgtattctaactcttcactcttgggcaaagataatagtattatcttttaccccattttttgtatgttttttcgtttattgagtttggcgtttcctatttagaaatagtacaatccggtcaatcattcgatagtgaaatatatatatttaactaggaaaattagtaaaacctcatttaaagatcattcaccttgatatatactactattgaccttttgttaatgaccattttcgtaaaaatgaactgcgattctcttctggaatttgttaccctaccttattcactaaatcagaaataataatgtgcagcgcccctttcataaagaaggcaagtatagggcatatagttaaaggtcagaactctttatccccaactacaagatcaattagaaaatcacatcata

SEQ ID NO: 210 - DNA, 600 bp, Artificial sequence
  Sc Oye2.promoter
actacaatttagcggcttagcacaatacgcgttttcaacttcctacgctagcgatgacaaaatgtctccaagaggcggaacttgcgacggatgcatggaaatatcttacgtaatgaacttccgtaatgaacttccgtaattcaagatctcttagcatctcttgttcaatcttcagactctactaagtgttcttaccaaccattggatgctcattacaaatgaatgaatatattgcacggaacggaagcggcatgctttttccgtgtcgtgtgcttagtaaagcaaaacggagtagaatcggtaagaacttcctttttgggttggaaaatcattgccattgtttggacacctttctttttccgtattgttcgagcaccgcgtttctttttgggtacttgatgaggtagcagattcctggaacgtgctttctctcgaggtaacctgccttgttcctcctggtgactttctaaaatataaaaggaaaagcatatctctagtttcgagttttttcttcatactttatttccttatgttaaacggtccagatatagaataaatcatcatattaagctaaatatagacgataatatagtatcgata

SEQ ID NO: 211 - DNA, 810 bp, Artificial sequence
  KANMX
atgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtttggctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaa

SEQ ID NO: 212 - DNA, 301 bp, Artificial sequence
  Adh1.Terminator
agcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaa

SEQ ID NO: 213 - DNA, 301 bp, Artificial sequence
  Adh2.terminator
agcggatctcttatgtctttacgatttatagttttcattatcaagtatgcctatattagtatatagcatctttagatgacagtgttcgaagtttcacgaataaaagataatattctactttttgctcccaccgcgtttgctagcacgagtgaacaccatccctcgcctgtgagttgtacccattcctctaaactgtagacatggtagcttcagcagtgttcgttatgtacggcatcctccaacaaacagtcggttatagtttgtcctgctcctctgaatcgtgtccctcgatatttctcat

SEQ ID NO: 214 - DNA, 301 bp, Artificial sequence
  Gmp1.Terminator
agtctgaagaatgaatgatttgatgatttctttttccctccatttttcttactgaatatatcaatgatatagacttgtatagtttattatttcaaattaagtagctatatatagtcaagataacgtttgtttgacacgattacattattcgtcgacatcttttttcagcctgtcgtggtagcaatttgaggagtattattaattgaataggttcattttgcgctcgcataaacagttttcgtcagggacagtatgttggaatgagtggtaattaatggtgacatgacatgttatagcaata

SEQ ID NO: 215 - DNA, 301 bp, Artificial sequence
  Sc Tal1.Terminator
aggaagtatctcggaaatattaatttaggccatgtccttatgcacgtttcttttgatacttacgggtacatgtacacaagtatatctatatatataaattaatgaaaatcccctatttatatatatgactttaacgagacagaacagttttttattttttatcctatttgatgaatgatacagtttcttattcacgtgttatacccacaccaaatccaatagcaataccggccatcacaatcactgtttcggcagcccctaagatcagacaaaacatccggaaccaccttaaatcaacgtc

SEQ ID NO: 216 - DNA, 301 bp, Artificial sequence
  Sc Tpi1.terminator
agattaatataattatataaaaatattatcttcttttctttatatctagtgttatgtaaaataaattgatgactacggaaagcttttttatattgtttctttttcattctgagccacttaaatttcgtgaatgttcttgtaagggacggtagatttacaagtgatacaacaaaaagcaaggcgctttttctaataaaaagaagaaaagcatttaacaattgaacacctctatatcaacgaagaatattactttgtctctaaatccttgtaaaatgtgtacgatctctatatgggttactca

SEQ ID NO: 217 - DNA, 285 bp, Artificial sequence
  Ag Tef1_lox.terminator
atcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctcataacttcgtataatgtatgctatacgaacggta

SEQ ID NO: 218 - DNA, 301 bp, Artificial sequence
  Sc Pdc1.terminator
agcgatttaatctctaattattagttaaagttttataagcatttttatgtaacgaaaaataaattggttcatattattactgcactgtcacttaccatggaaagaccagacaagaagttgccgacagtctgttgaattggcctggttaggcttaagtctgggtccgcttctttacaaatttggagaatttctcttaaacgatatgtatattcttttcgttggaaaagatgtcttccaaaaaaaaaaccgatgaattagtggaaccaaggaaaaaaaaagaggtatccttgattaaggaaca

SEQ ID NO: 219 - DNA, 301 bp, Artificial sequence
  Sc Tdh1.terminator
aataaagcaatcttgatgaggataatgatttttttttgaatatacataaatactaccgtttttctgctagattttgtgaagacgtaaataagtacatattactttttaagccaagacaagattaagcattaactttacccttttctcttctaagtttcaatactagttatcactgtttaaaagttatggcgagaacgtcggcggttaaaatatattaccctgaacgtggtgaattgaagttctaggatggtttaaagatttttcctttttgggaaataagtaaacaatatattgctgcctt

SEQ ID NO: 220 - DNA, 301 bp, Artificial sequence
  Sc Eno1.terminator
aagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcc

SEQ ID NO: 221 - DNA, 1000 bp, Artificial Sequence
  Kl prom 3.pro
gagcctgtccaagcaaatgccttctcataaatggtgccaaagacccgcaagcccaaagcaattaccccccaaaaagaaatgatatagtgcaagatacgtatatgaccatgacttgactaggtgaaacagtgcagaaacagccgcacaaaagcagccctaaccctcagagtcgattttactctttcaggtaataaagcctcgacatcaattttagacagaagccaggctggcctcgagattatagccataggcaagcaagaggagagaaggggaggccccccatggggggcctcccccccgctgtcaaggtttggcagaacctagcttcattaggccactagcccagcctaaaacgtcaacgggcaggaggaacactcccacaagacggcgtagtattctcgattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaa

SEQ ID NO: 222 - DNA, 1000 bp, Artificial sequence; identical to SEQ ID NO: 221
  Kl prom 2.pro

SEQ ID NO: 223 - DNA, 600 bp, Artificial sequence
  Sc PRE3.promoter
caaacattaatttgttctgcatactttgaacctttcagaaaataaaaaacattacgcgcatacttaccctgctcgcgaagaagagtaacactaacgcattctatgggcaattgaagacagtattcagtacaagacatagtccgtttccttgagtcaattcctatagcattatgaactagccgcctttaagagtgccaagctgttcaacaccgatcatttttgatgatttggcgtttttgttatattgatagatttcttttgaattttgtcattttcacttttccactcgcaacggaatccggtggcaaaaaagggaaaagcattgaaatgcaatctttaacagtattttaaacaagttgcgacacggtgtacaattacgataagaattgctacttcaaagtacacacagaaagttaacatgaatggaattcaagtggacatcaatcgtttgaaaaagggcgaagtcagtttaggtacctcaatgtatgtatataagaatttttcctcccactttattgtttctaaaagttcaatgaagtaaagtctcaattggccttattactaactaataggtatcttataatcacctaataaaataga

The invention claimed is:

1. A steviol glycoside having the formula (IV)

(IV)

[chemical structure of steviol glycoside with β-Glc$^{II}$, β-Glc$^{III}$, β-Glc$^{IV}$, β-Glc$^{V}$, β-Glc$^{VI}$, β-Glc$^{VII}$, β-Glc$^{I}$ groups]

2. The steviol glycoside according to claim 1, wherein it is fermentatively produced.

3. A method for production of a steviol glycoside according to claim 1, which method comprises:
providing a recombinant yeast cell comprising recombinant nucleic acid sequences encoding polypeptides comprising the amino acid sequences encoded by: SEQ ID NO: 61, SEQ ID NO: 65, SEQ ID NO: 23, SEQ ID NO: 33, SEQ ID NO: 77, SEQ ID NO: 71, SEQ ID NO: 87, SEQ ID NO: 73 and SEQ ID NO: 75;
fermenting the recombinant yeast cell in a suitable fermentation medium.

4. A composition comprising a steviol glycoside according to claim 1 and one or more different steviol glycosides.

5. A foodstuff, feed and/or beverage which comprises a steviol glycoside according to claim 1.

6. A product comprising a steviol glycoside according to claim 1 in a sweetener composition or flavor composition.

7. A product comprising a steviol glycoside according to claim 1 in a foodstuff, feed and/or beverage.

8. The method of claim 3, further comprising recovering the steviol glycoside from the fermentation medium.

* * * * *